United States Patent
Mulder et al.

(10) Patent No.: US 9,839,655 B2
(45) Date of Patent: Dec. 12, 2017

(54) COMPOSITIONS COMPRISING BACTERIAL STRAINS

(71) Applicant: 4D Pharma Research Limited, Aberdeen (GB)

(72) Inventors: Imke Elisabeth Mulder, Aberdeen (GB); Amy Beth Holt, Aberdeen (GB); Domenico Panzica, Aberdeen (GB); Seanin Marie McCluskey, Aberdeen (GB)

(73) Assignee: 4D Pharma Research Limited, Aberdeen (GB)

(*) Notice: Subject to any disclaimer, the term of this patent is extended or adjusted under 35 U.S.C. 154(b) by 0 days.

(21) Appl. No.: 15/357,850

(22) Filed: Nov. 21, 2016

(65) Prior Publication Data

US 2017/0143772 A1    May 25, 2017

(30) Foreign Application Priority Data

Nov. 20, 2015   (GB) .................................. 1520502.4
Mar. 23, 2016   (GB) .................................. 1604924.9

(51) Int. Cl.
| | | |
|---|---|---|
| A61K 9/19 | (2006.01) | |
| A61K 39/09 | (2006.01) | |
| A61K 35/74 | (2015.01) | |
| A61K 45/06 | (2006.01) | |
| A61K 31/739 | (2006.01) | |
| A23L 33/135 | (2016.01) | |
| A23C 9/158 | (2006.01) | |
| A61K 35/00 | (2006.01) | |
| A61K 39/00 | (2006.01) | |

(52) U.S. Cl.
CPC ............ *A61K 35/74* (2013.01); *A23C 9/1585* (2013.01); *A23L 33/135* (2016.08); *A61K 9/19* (2013.01); *A61K 31/739* (2013.01); *A61K 39/09* (2013.01); *A61K 45/06* (2013.01); *A23V 2002/00* (2013.01); *A61K 2035/11* (2013.01); *A61K 2039/585* (2013.01)

(58) Field of Classification Search
CPC ............ A61K 2300/00; A61K 31/4375; A61K 31/444; A61K 31/4545; A61K 31/4709; A61K 31/496; A61K 31/506; A61K 38/12; C07D 455/02
See application file for complete search history.

(56) References Cited

U.S. PATENT DOCUMENTS

| | | | |
|---|---|---|---|
| 7,749,494 | B2 | 7/2010 | Renaud et al. |
| 7,998,474 | B2 | 8/2011 | Kelly |
| 9,011,834 | B1 | 4/2015 | McKenzie et al. |
| 9,314,489 | B2 | 4/2016 | Kelly et al. |
| 9,539,293 | B2 | 1/2017 | Kelly et al. |
| 2003/0147858 | A1 | 8/2003 | Renaud et al. |
| 2008/0069861 | A1 | 3/2008 | Brown et al. |
| 2010/0284973 | A1 | 11/2010 | Schiffer-Mannioui et al. |
| 2010/0303782 | A1 | 12/2010 | Cobb et al. |
| 2010/0311686 | A1 | 12/2010 | Kasper et al. |
| 2010/0316617 | A1 | 12/2010 | Renaud et al. |
| 2014/0037716 | A1 | 2/2014 | Nowill et al. |
| 2014/0147425 | A1 | 5/2014 | Henn et al. |
| 2014/0199281 | A1 | 7/2014 | Henn et al. |
| 2014/0335131 | A1 | 11/2014 | Mazmanian et al. |
| 2014/0341921 | A1 | 11/2014 | Honda et al. |
| 2015/0071957 | A1 | 3/2015 | Kelly et al. |
| 2015/0104418 | A1 | 4/2015 | Flint et al. |
| 2016/0067188 | A1 | 3/2016 | Cade et al. |
| 2016/0279177 | A1 | 9/2016 | Kelly et al. |

FOREIGN PATENT DOCUMENTS

| | | |
|---|---|---|
| CN | 101590081 A | 12/2009 |
| CN | 102940652 A | 2/2013 |
| CN | 103156888 A | 6/2013 |
| CN | 103981115 A | 8/2014 |
| CN | 102940652 B | 3/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| EP | 2832859 A1 | 2/2015 |
| JP | H08259450 A | 10/1996 |
| JP | 2003261453 A | 9/2003 |
| JP | 2005097280 A | 4/2005 |
| JP | 2007084533 A | 4/2007 |
| JP | 2007116991 A | 5/2007 |
| KR | 20100128168 A | 12/2010 |
| WO | WO-9919459 A1 | 4/1999 |
| WO | WO-03046580 A1 | 6/2003 |
| WO | WO-2009027753 A1 | 3/2009 |
| WO | WO-2009072889 A1 | 6/2009 |
| WO | WO-2011110918 A1 | 9/2011 |
| WO | WO-2011149335 A1 | 12/2011 |

(Continued)

OTHER PUBLICATIONS

Accession No. JN102572, Nov. 7, 2011.*
Atarashi et al., Th17 Cell Induction by Adhesion of Microbes to Intestinal Epithelial Cells. Cell, vol. 163, No. 2, Oct. 8, 2015. pp. 367-380.
Atarashi, K. et al., Treg induction by a rationally selected mixture of Clostridia strains from the human microbiota. Nature. 2013; 500(7461):232-236.
"Campeau, J.L. et al., Intestinal Epithelial Cells Modulate Antigen-Presenting Cell Responses to Bacterial DNA. Infectionand Immunity. Aug. 2012; 80(8): 2632-2644."
Chen, S. et al., Live combined bacillus subtilis and enterococcus faecium ameliorate murine experimental colitis by immunosuppression. International journal of inflammation. 2014(878054). 7 Pages.
Co-pending U.S. Appl. No. 15/357,936, filed Nov. 21, 2016.

(Continued)

*Primary Examiner* — Padmavathi Baskar
(74) *Attorney, Agent, or Firm* — Wilson Sonsini Goodrich Rosati

(57) ABSTRACT

The invention provides compositions comprising bacterial strains for treating and preventing cancer.

10 Claims, 7 Drawing Sheets

(56) References Cited

FOREIGN PATENT DOCUMENTS

| WO | WO-2011153226 A2 | 12/2011 |
|----|------------------|---------|
| WO | WO-2011153226 A3 | 3/2012 |
| WO | WO-2013008039 A2 | 1/2013 |
| WO | WO-2013050792 A1 | 4/2013 |
| WO | WO-2014121298 A2 | 8/2014 |
| WO | WO-2014121304 A1 | 8/2014 |
| WO | WO-2014167338 A1 | 10/2014 |
| WO | WO-2014201037 A2 | 12/2014 |
| WO | WO-2015021936 A1 | 2/2015 |
| WO | WO-2015095241 A2 | 6/2015 |
| WO | WO-2015156419 A1 | 10/2015 |
| WO | WO-2016019506 A1 | 2/2016 |

OTHER PUBLICATIONS

Co-pending U.S. Appl. No. 15/359,144, filed Nov. 22, 2016.
Co-pending U.S. Appl. No. 15/359,972, filed Nov. 23, 2016.
Co-pending U.S. Appl. No. 15/359,988, filed Nov. 23, 2016.
Dahya V. et al., Clostridium ramosum Osteomyelitis in an immunocompetent patient after traumatic injury, Infectious Diseases in Clinical Practice Mar. 12, 2015 Lippincott Williams and Wilkins USA, vol. 23, No. 2, Mar. 12, 2015, pp. 102-104, XP009193312, ISSN: 1056-9103 the whole document.
Duncan et al. (2002) "*Roseburia intestinal is* sp. nov., a novel saccharolytic, butyrate-producing bacterium from human faeces," International Journal System Evolutionary Microbiology. 52:1615-1620.
Duncan et al. (2006) "Proposal of Roseburia faecis sp. nov., *Roseburia hominis* sp. nov. and *Roseburia inulinivorans* sp. nov., based on isolates from human faeces," International Journal of Systematic and Evolutionary Microbiology.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application no. 1520631.1.
GB Search and Exam report dated Nov. 17, 2016 for GB application 1520502.4.
GB Search and Exam report dated Sep. 13, 2016 for GB application 1520497.7.
Ghadimi, D. et al., Epigenetic imprinting by commensal probiotics inhibits the IL-23/IL-17 axis in an in vitro model of the intestinal mucosal immune system. JLB. 2012;92(4):895-911.
International Search Report dated Jan. 27, 2017 for International Application No. PCT/GB2016/053622.
International Search Report dated Feb. 17, 2017 for International Application No. PCT/GB2016/053676.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Kverka, M. et al., Oral administration of Parabacteroides distasonis antigens attenuates experimental murine colitis through modulation of immunity and microbiota composition. Clinical & Experimental Immunology. 2010; 163:250-259.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Miyake, T. et al., Phylogenetic Analysis of the Genus *Bifidobacterium* and Related Genera Based on 16S rDNA Sequences. Microbiol. Immunol. 1998; 42(10):661-667.
Overstreet et al. 'Dysbiosis Characterized by Reduced Abundance of Roseburia is Associated With Increased Severity of Colitis in IL-10-/-Mice'. Gastroenterology. 2011, vol. 140, No. 5, Suppl. 1, pp. S-696.
Park, S.K. et al., *Blautia stercoris* sp. nov., isolated from human faeces. International journal of systematic and evolutionary microbiology. 2012; 62(4): 776-779.
Patel., R. et al., Determination of 16S rRNA sequences of enterococci and application to species identification of nonmotile enterococcus gallinarum isolates. Journal of clinical microbiology, 1998; 36(11):3399-3407.
Sakamoto, M. et al., Reclassification of Bacteroides distasonis, Bacteroides goldsteinii and Bacteroides merdae as *Parabacteroides distasonis* gen. nov., comb. nov., *Parabacteroides goldsteinii* comb. nov. and *Parabacteroides merdae* comb. nov. International journal of systematic and evolutionary microbiology. 2006; 56: 1599-1605.
Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.
Severijnen, et al., Chronic Arthritis Induced in Rats by Cell Wall Fragments of *Eubacterium* Species from the Human Intestinal Flora. Infection and Immunity, Feb. 1990; 58(2): p. 523-528.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivieri, K. et al., Probiotic enterococcus faecium CRL 183 inhibit chemically induced colon cancer in male wistar rats. Eur Food Res Technol. 2008; 228:231-237.
Tesmer, LA. et al., Th17 cells in human disease. Immunol Rev. 2008;223:87-113.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Udayappan, et al., Oral treatment with Eubacterium hallii improves insulin sensitivity in db/db mice. NPJ Biofilms and microbiomes, vol. 2, Jul. 6, 2016; p. 16009.
Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.
Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.

(56) References Cited

OTHER PUBLICATIONS

Zhang, B. et al., Oral administration of enterococcus faecalis FK-23 suppresses Th17 cell development and attenuates allergic airway responses in mice. International journal of molecular medicine. 2012; 30:248-254.
Zheng, B. et al., Bifidobacteriu breve attenuates murine dextran sodium sulfate-induced colitis and increases regulatory T cell responses. PLOS one. May 2014; 9(5).
Zhongyuan, T. et al., The inflammation regulation effects of enterococcus faecium HDRsEf1 on human enterocyte-like HT-29 cells. Animal cells and systems. Mar. 2016;20(2):70-76.
Zitomersky, N. et al., Characterization of Adherent Bacteroidales from Intestinal Biopsies of Children and Young Adults with Inflammatory Bowel Disease. PLOS one. 2013; 8(6).
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Atlas, R. Handbook of Microbiological Media, Fourth Edition. CRC Press. 2010.
Azad, M.B. et al., Probiotic supplementation during pregnancy or infancy for the prevention of asthma and wheeze: systematic review and meta-analysis BMJ 2013; 347 :f6471.
Bagge, et al., Diversity of spore-forming bacteria in cattle manure, slaughterhouse waste and samples from biofas plants. Journal of applied material. Jan. 2010.
Balato, et al., Effects of adalimumab therapy in adult subjects with moderate-to-severe psoriasis on Th17 pathway. (2014) J Eur Acad Dermatol Venereol. 28(8):1016-24.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.
Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Darlington, G.J., Liver Cell Lines. (1987) Meth Enzymol. 151:19-38.
Day, J.G. et al., Cryopreservation and Freeze-Drying Protocols. Springer. 2007. 2nd edition.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Eckburg, PB. et al., Diversity of the human intestinal microbial flora.Science. Jun. 10, 2005;308(5728):1635-8. Epub Apr. 14, 2005.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.

Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Frank, D. et al., Molecular-phylogenetic characterization of microbial community imbalances in human inflammatory bowel diseases. 2007. PNAS. 104(34):13780-5.
Gennaro, A.R., Remington: The Science and practice of pharmacy. 20th edition. 2000.
Goldin, B.R. et al., Clinical indications for probiotics: an overview. Clin Infect Dis. Feb. 1, 2008;46 Suppl 2:S96-100; discussion S144-51. doi: 10.1086/523333.
Guide for the care and use of laboratory animals: 8th edition. The national academic press; 2011.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.
Holdeman, et al., *Eubacterium contortum* (Prevot) comb. nov.: Emendation of description and designation of the type strain. International journal of systematic bacteriology. Oct. 1971;21(4): 304-306.
Ispirli, H. et al., Characterization of functional properties of Enterococcus faecium strains isolated from human gut. Characterization of functional properties of Enterococcus faecium strains isolated from human gut.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Kallasapathy, K. Microencapsulation of Probiotic Bacteria:Technology and Potential Applications. Curr. Issues Intest. Microbiol. (2002) 3: 39-48.
Kanauchi, et al., Eubacterium limosum (probiotic) and its metabolites showed anti-inflammatory effects and increased mucosal barrier function in colitis. S1912.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Karin, M. Nuclear factor-kappaB in cancer development and progression. Nature. May 25, 2006;441(7092):431-6.
Koenders, M.I. et al., Interleukin-17 Acts Independently of TNF-a under Arthritic Conditions. (2006) J. Immunol. 176:6262-6269.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lejeune, FJ. et al., Efficiency of Recombinant Human TNF in Human Cancer Therapy. (2006) Cancer Immun. 6:6.
Leslie, et al., Trehalose and sucrose protect both membranes and proteins in intact bacteria during drying. (1995) Appl. Environ. Microbiol. 61, 3592-3597.
Luger, D. and Caspi, R.R., New perspectives on effector mechanisms in uveitis. (2008) Semin. Immunopathol. 30(2): 134-143.
Machiels, K. A decrease of the butyrate-producing species *Roseburia hominis* and *Faecalibacterium prausnitzii* defines dysbiosis in patients with ulcerative colitis.Gut. Aug. 2014;63(8):1275-83. doi: 10.1136/gutjnl-2013-304833. Epub Sep. 10, 2013.
MacPherson, AJ. et al., IgA responses in the intestinal mucosa against pathogenic and non-pathogenic microorganisms. Oct. 2001. 3(12). 1021-1035.
MacPherson, AJ., et al., The functions of mucosal T cells in containing the indigenous commensal flora of the intestine.Cell Mol Life Sci. Dec. 2002;59(12):2088-96.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.

(56) References Cited

OTHER PUBLICATIONS

Masco, L., et al., Identification of *Bifidobacterium* Species Using rep-PCR Fingerprinting. Systematic and Applied Microbiology 26(4):557-63 • Dec. 2003.
Maya, J.R. et al., Emerging Therapies for Noninfectious Uveitis: What May Be Coming to the Clinics. (2014) J. Ophthalmology. 310329.
Mazmanian, Sk., An immunomodulatory molecule of symbiotic bacteria directs maturation of the host immune system.Cell. Jul. 15, 2005;122(1):107-18.
Miossec, P. et al. Targeting IL-17 and TH17 cells in chronic inflammation. Nat Rev Drug Discov. Oct. 2012;11(10):763-76. doi: 10.1038/nrd3794.
Mitropoulou, G. et al. Immobilization Technologies in Probiotic Food Production. (2013) Journal Nutr Metab. (2013) 716861.
Miyamoto-Shinohara, Y. et al., Survival of freeze-dried bacteria. J Gen Appl Microbiol. Feb. 2008;54(1):9-24.
Monteleone, I. et al., Th17-related cytokines: new players in the control of chronic intestinal inflammation. (2011) BMC Medicine. 2011, 9:122.
Mucientes, A. et al., Specific association of IL17A genetic variants with panuveitis. (2015) Br J Ophthalmol. 99(4):566-70.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Pace et al. Macrophage activiation: Priming activity from a T-cell hybridoma is attributable to interferon. (1983) PNAS. 80:3782-6.
Rockwell, S.C. et al., Characteristics of a Serially Transplanted Mouse Mammary Tumor and Its Tissue-Culture-Adapted Derivative. (1972) J Natl Cancer Inst. 49:735-49.
Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of Streptococcus faecalis and Streptococcus faecium to the Genus *Enterococcus* nom. rev. as *Enterococcus faecalis* comb. nov. and *Enterococcus faecium* comb. nov. Int J Syst Evol Microbiol, Jan. 1984 34: 31-34, doi:10.1099/00207713-34-1-31.
Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar.-Apr. 2015;29(2):533-43. doi: 10.1111/jvim.12563. Epub Mar. 16, 2015.
Severijnen, A. J. et al., Chronic Arthritis Induced in Rats by Cell Wall Fragments of *Eubacterium* Species from the Human Intestinal Flora. Infection and Immunity, 1990, vol. 58, No. 2, 523-528.
Sgadari, C. et al., Interferon-inducible protein-10 identified as a mediator of tumor necrosis in vivo. (1996) PNAS. 93:13791-6.
Sgadari et al. Mig, the Monokine Induced by Interferon-g, Promotes Tumor Necrosis in Vivo. (1997) Blood. 89:2635-43.
Shabgah, A.G. et al., Interleukin-17 in human inflammatory diseases. Postepy Dermatol Alergol. Aug. 2014; 31(4): 256-261.
Simpson-Herren, L. et al., Kinetic parameters and growth curves for experimental tumor systems. Cancer Chemother Rep. Jun. 1970;54(3):143-74.
Smith, T.F. et al., Comparison of biosequences. (1981) Adv. Appl. Math. 2: 482-489.
Spor, A. et al., Unravelling the effects of the environment and host genotype on the gut microbiome. Nat Rev Microbiol. Apr. 2011;9(4):279-90. doi: 10.1038/nrmicro2540.
Srutkova, D. et al., Efficiency of PCR-based methods in discriminating *Bifidobacterium longum* ssp. longum and *Bifidobacterium longum* ssp. infantis strains of human origin.J Microbiol Methods. Oct. 2011;87(1):10-6. doi: 10.1016/j.mimet.2011.06.014. Epub Jul. 2, 2011.
Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.
Strobel, H.J. Basic laboratory culture methods for anaerobic bacteria. Methods Mol Biol. 2009;581:247-61. doi: 10.1007/978-1-60761-214-8_16.
Sun, D. et al., The role of Th17-associated cytokines in the pathogenesis of experimental autoimmune uveitis (EAU). (2015) Cytokine. 74(1):76-80.
Tsukinowa, et al., Fecal microbiota of a dugong (*Dugong dugong*) in captivity at Toba Aquarium. J. Gen. Appl. Microbiol., 54, 25-38 (2008).
Workman et al. Guidelines for the welfare and use of animals in cancer research (2010) Br. J. Cancer. 102:1555-77.
Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.
Ye, X. et al., The Role of IL-23/Th17 Pathway in Patients with Primary Immune Thrombocytopenia. (2015) PLoS One. 10(1):e0117704.
Yin, X. et al., Combined effect of five single nucleotide polymorphisms related to IL23/Th17 pathway in the risk of psoriasis.Immunogenetics. Mar. 2014;66(3):215-8. doi: 10.1007/s00251-013-0756-z. Epub Jan. 14, 2014.
Yutin, N. and Galperin, M.Y., A genomic update on clostridial phylogeny:Gram-negative spore formers and other misplaced clostridia. Environmental microbiology. 20136; 15(10): 2631-2641.
Zhang, B. et al., The Prevalence of Th17 Cells in Patients With Gastric Cancer. 2008. Biochem Biophys Res Commun 374 (3), 533-537.
Zhang, et al., The Activation of NF-κb in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.
Zitvogel, et al., Type I interferons in anticancer immunity. Nature Reviews. Jul. 2015:405-414.
Arenberg, et al., Interferon-γ-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Gennaro, A.R., Remington's Pharmaceutical sciences, Mack publishin co. 1985.
Office Action dated Jun. 26, 2017 for U.S. Appl. No. 15/357,936.
Office Action dated Jul. 6, 2017 for U.S. Appl. No. 15/070,605.
Office Action dated Jul. 31, 2017 for U.S. Appl. No. 15/359,988.
Stoll et al., Altered microbiota associated with abnormal humoral immune responses to commensal organisms in enthesitis-related arthritis, 2014; Arthritis Res Ther. 16:486.
Vetrovsky, T. and Baldrian, P., The variability of the 16S rRNA gene in bacterial genomes and its consequences for bacterial community analyses. Plos One. Feb. 2013; 8(2): e57923.

* cited by examiner

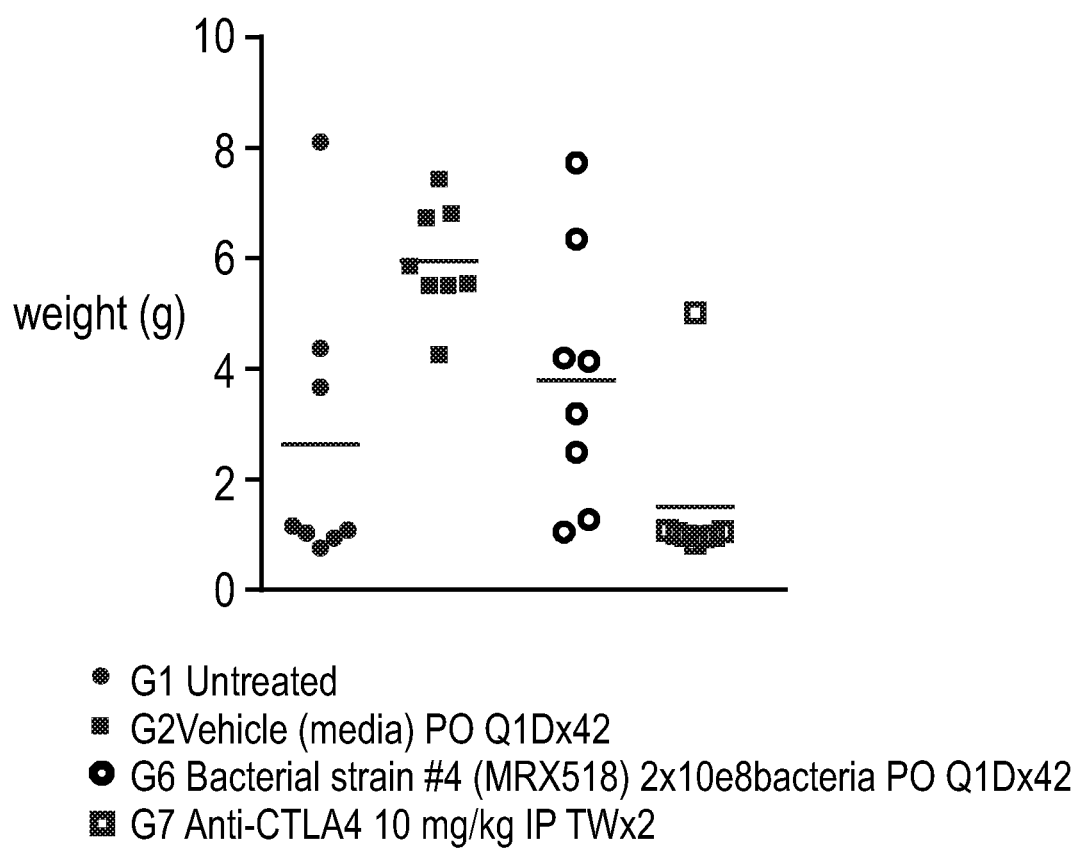

Negative control

Positive Control

Addition of MRX518

Addition of MRX518 and LPS

Negative control (No bacteria)

Negative Control (Bacterial sediment)

Addition of MRX518

COMPOSITIONS COMPRISING BACTERIAL STRAINS

SEQUENCE LISTING

The instant application contains a Sequence Listing which has been submitted electronically in ASCII format and is hereby incorporated by reference in its entirety. Said ASCII copy, created on Nov. 18, 2016, is named 49455-709-201_P067592XX_sequence_listing.txt and is 3,999,976 bytes in size.

CROSS REFERENCE

This application claims priority to GB Application No. 1604924.9, filed on Mar. 23, 2016, and to GB Application No. 1520502.4, filed on Nov. 20, 2015, both of which are herein incorporated by reference in their entirety.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in subjects with IBD whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterized. For example, certain *Enterococcus* species have been implicated in causing cancer [16].

There is a requirement in the art for new methods of treating diseases. There is also a requirement for the potential effects of gut bacteria to be characterized so that new therapies using gut bacteria can be developed.

SUMMARY OF THE INVENTION

The inventors have developed new therapies for treating and preventing diseases. In particular, the inventors have developed new therapies for treating and preventing cancer. In particular, the inventors have identified that bacterial strains of the species *Enterococcus gallinarum* can be effective for treating and preventing cancer. As described in the examples, oral administration of compositions comprising *Enterococcus gallinarum* may reduce tumor size in mouse models of cancer.

In preferred embodiments, the invention provides a composition comprising a bacterial strain of the species *Enterococcus gallinarum*, for use in a method of treating or preventing cancer, such as breast, lung or liver cancer. The inventors have identified that treatment with compositions comprising a bacterial strain of the species *Enterococcus gallinarum* can reduce tumor growth in mouse models of breast, lung and liver cancer. In certain embodiments, the composition is for use in a method of reducing tumor size or preventing tumor growth in the treatment of cancer. Compositions using *Enterococcus gallinarum* may be particularly effective for reducing tumor size or preventing tumor growth in the treatment of cancer.

In preferred embodiments of the invention, the bacterial strain in the composition is of *Enterococcus gallinarum*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Enterococcus gallinarum*. Preferably, the bacterial strain has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

Accordingly, the invention also provides a composition comprising a bacterial strain that has a 16s rRNA sequence that is at least 95% identical to the 16s rRNA sequence of a bacterial strain of *Enterococcus gallinarum* for use in a method of treating or preventing cancer. In particular, the invention provides a composition comprising a bacterial strain that has a 16s rRNA sequence that is at least 95% identical to SEQ ID NO: 2 for use in a method of treating or preventing cancer. In some embodiments, the bacterial strain in the composition is not of *Enterococcus gallinarum*. In some embodiments, the bacterial strain in the composition is not of *Enterococcus gallinarum*, but is a closely related strain.

In certain embodiments, the composition of the invention is for oral administration. Oral administration of the strains of the invention can be effective for treating cancer. Also, oral administration is convenient for patients and practitioners and allows delivery to and/or partial or total colonization of the intestine.

In certain embodiments, the composition of the invention comprises one or more pharmaceutically acceptable excipients or carriers.

In certain embodiments, the composition of the invention comprises a bacterial strain that has been lyophilized. Lyophilization is an effective and convenient technique for preparing stable compositions that allow delivery of bacteria.

In certain embodiments, the composition comprises a lyoprotectant which is a pharmaceutically acceptable excipient, diluent, or carrier.

In certain embodiments, the composition comprises a bacterial strain that has been lyophilized; and further comprises a pharmaceutically acceptable excipient, diluent, or carrier.

In certain embodiments, the composition is a lyophilized composition. In some cases, the lyophilized composition may be reconstituted prior to administration to a subject. In some cases, the reconstitution is with a diluent described herein. In some cases, the diluent may be sterile water, sodium chloride solution, or dextrose solution.

In certain embodiments, the invention provides a food product comprising the composition as described above.

In certain embodiments, the invention provides a vaccine composition comprising the composition as described above.

Additionally, the invention provides a method of treating or preventing cancer, comprising administering a composition comprising a bacterial strain of the species *Enterococcus gallinarum*.

In developing the above invention, the inventors have identified and characterized a bacterial strain that is particularly useful for therapy. The *Enterococcus gallinarum* strain of the invention is shown to be effective for treating cancer. Therefore, in another aspect, the invention provides a cell of the *Enterococcus gallinarum* strain deposited under accession number NCIMB 42488, or a derivative thereof. The invention also provides compositions comprising such cells, or biologically pure cultures of such cells. The invention also provides a cell of the *Enterococcus gallinarum* strain deposited under accession number NCIMB 42488, or a derivative thereof, for use in therapy, in particular for cancer. Similarly, the invention provides a cell of a bacterial strain that has a 16s rRNA sequence that is at least 95% identical to SEQ ID NO: 2, or a derivative thereof. The invention also provides compositions comprising such cells, or biologically pure cultures of such cells. The invention also provides a cell of a bacterial strain that has a 16s rRNA sequence that is at least 95% identical to SEQ ID NO:2, or a derivative thereof, for use in therapy, in particular for treating or preventing cancer.

INCORPORATION BY REFERENCE

All publications, patents, and patent applications mentioned in this specification are herein incorporated by reference in their entirety for all purposes, to the same extent as if each individual publication, patent, or patent application was specifically and individually indicated to be incorporated by reference.

BRIEF DESCRIPTION OF DRAWINGS

FIG. 3: Mouse model of liver cancer-liver weight.

DETAILED DESCRIPTION

Bacterial Strains

Figure 1:
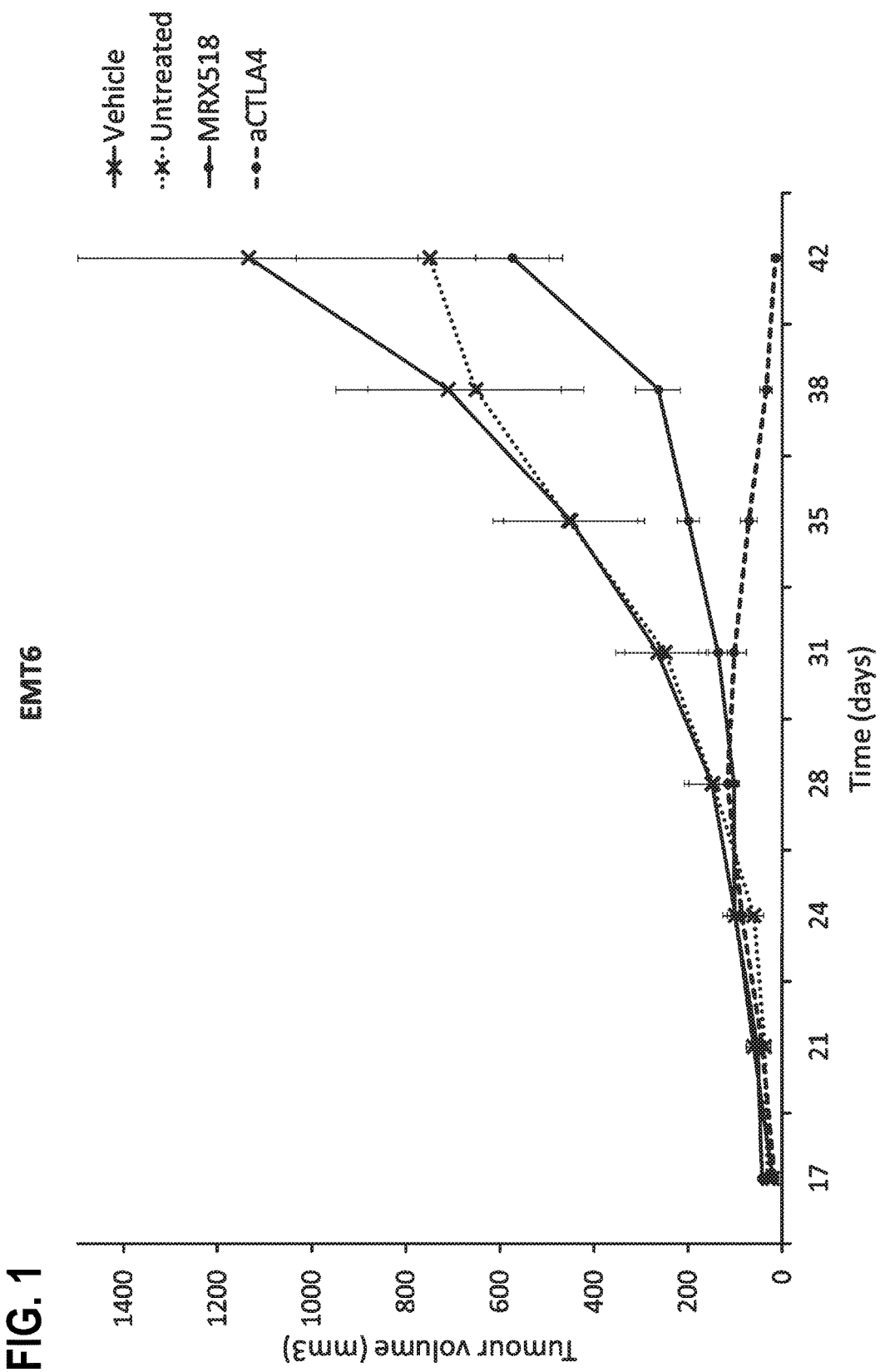
FIG. 1: Mouse model of breast cancer-tumor volume.

The compositions of the invention comprise a bacterial strain of the species *Enterococcus gallinarum*. The examples demonstrate that bacteria of this species are useful for treating or preventing cancer.

The invention also provides compositions comprising a bacterial strain that has a 16s rRNA sequence that is at least 95% identical to the 16s rRNA sequence of a bacterial strain of *Enterococcus gallinarum* for use in therapy, for example, for use in a method of treating or preventing cancer. In particular, the invention also provides compositions comprising a bacterial strain that has a 16s rRNA sequence that is at least 95% identical to SEQ ID NO: 2 for use in therapy, for example, for use in a method of treating or preventing cancer. In some embodiments, the bacterial strain in the composition is not of *Enterococcus gallinarum*, but is a closely related strain.

The invention provides an *Enterococcus gallinarum* for use in therapy, for example, for use in treating or preventing cancer. Similarly, the invention provides a composition comprising a bacterial strain of the species *Enterococcus gallinarum*, for use in therapy, for example, for use in treating or preventing cancer. In certain embodiments, the compositions of the invention comprise a bacterial strain that has a 16s rRNA sequence that is at least 95% identical to SEQ ID NO: 2, for example which is a *Enterococcus gallinarum*, and do not contain any other bacterial genus. In certain embodiments, the compositions of the invention comprise a single strain of a bacterial strain that has a 16s rRNA sequence that is at least 95% identical to SEQ ID NO: 2, for example, which is an *Enterococcus gallinarum*, and do not contain any other bacterial strain or species.

*Enterococcus gallinarum* forms coccoid cells, mostly in pairs or short chains. It is nonmotile and colonies on blood agar or nutrient agar are circular and smooth. *Enterococcus gallinarum* reacts with Lancefield group D antisera. The type strain of *Enterococcus gallinarum* is F87/276=PB21=ATCC 49573=CCUG 18658=CIP 103013=JCM 8728=LMG 13129=NBRC 100675=NCIMB 702313 (formerly NCDO 2313)=NCTC 12359 [17]. The GenBank accession number for a 16S rRNA gene sequence of *Enterococcus gallinarum* is AF039900 (disclosed herein as SEQ ID NO:1). An exemplary *Enterococcus gallinarum* strain is described in [17].

All microorganism deposits were made under the terms of the Budapest Treaty. Maintenance of a viable culture is assured for 30 years from the date of deposit. All restrictions on the availability to the public of the deposited microorganisms will be irrevocably removed upon the granting of a patent for this application. The *Enterococcus gallinarum* bacterium deposited under accession number NCIMB 42488 was tested in the Examples and is also referred to herein as strain MRX518. References to MRX518 and MRx0518 are used interchangeably. A 16S rRNA sequence for the MRX518 strain that was tested is provided in SEQ ID NO:2. Strain MRX518 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 16 Nov. 2015 as "*Enterococcus sp*" and was assigned accession number NCIMB 42488.

The genome of strain MRX518 comprises a chromosome and plasmid. A chromosome sequence for strain MRX518 is provided in SEQ ID NO:3. A plasmid sequence for strain MRX518 is provided in SEQ ID NO:4. These sequences were generated using the PacBio RS II platform.

Bacterial strains closely related to the strain tested in the examples are also expected to be effective for treating or preventing cancer. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Enterococcus gallinarum*. Preferably, the bacterial strain for use in the invention has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

Bacterial strains that are biotypes of the bacterium deposited under accession number 42488 are also expected to be effective for treating or preventing cancer. A biotype is a closely related strain that has the same or very similar physiological and biochemical characteristics.

Strains that are biotypes of the bacterium deposited under accession number NCIMB 42488 and that are suitable for use in the invention may be identified by sequencing other nucleotide sequences for the bacterium deposited under accession number NCIMB 42488. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, (GTG)$_5$, or REP or [18]. Biotype strains may have sequences with at least 95%, 96%, 97%, 98%, 99%, 99.5% or 99.9% sequence identity to the corresponding sequence of the bacterium deposited under accession number NCIMB 42488. In some embodiments, a biotype strain has a sequence with at least 95%, 96%, 97%, 98%, 99%, 99.5% or 99.9% sequence identity to the corresponding sequence of strain MRX518 deposited as NCIMB 42488 and comprises a 16S rRNA sequence that is at least 99% identical (e.g. at least 99.5% or at least 99.9% identical) to SEQ ID NO:2. In some embodiments, a biotype strain has a sequence with at least 95%, 96%, 97%, 98%, 99%, 99.5% or 99.9% sequence identity to the corresponding sequence of strain MRX518 deposited as NCIMB 42488 and has the 16S rRNA sequence of SEQ ID NO:2.

In certain embodiments, the bacterial strain for use in the invention has a chromosome with sequence identity to SEQ ID NO:3. In preferred embodiments, the bacterial strain for use in the invention has a chromosome with at least 90% sequence identity (e.g. at least 92%, 94%, 95%, 96%, 97%, 98%, 99% or 100% sequence identity) to SEQ ID NO:3 across at least 60% (e.g. at least 65%, 70%, 75%, 80%, 85%, 95%, 96%, 97%, 98%, 99% or 100%) of SEQ ID NO:3. For example, the bacterial strain for use in the invention may have a chromosome with at least 90% sequence identity to SEQ ID NO:3 across 70% of SEQ ID NO:3, or at least 90% sequence identity to SEQ ID NO:3 across 80% of SEQ ID NO:3, or at least 90% sequence identity to SEQ ID NO:3 across 90% of SEQ ID NO:3, or at least 90% sequence identity to SEQ ID NO:3 across 100% of SEQ ID NO:3, or at least 95% sequence identity to SEQ ID NO:3 across 70% of SEQ ID NO:3, or at least 95% sequence identity to SEQ ID NO:3 across 80% of SEQ ID NO:3, or at least 95% sequence identity to SEQ ID NO:3 across 90% of SEQ ID NO:3, or at least 95% sequence identity to SEQ ID NO:3 across 100% of SEQ ID NO:3, or at least 98% sequence identity to SEQ ID NO:3 across 70% of SEQ ID NO:3, or at least 98% sequence identity to SEQ ID NO:3 across 80% of SEQ ID NO:3, or at least 98% sequence identity to SEQ ID NO:3 across 90% of SEQ ID NO:3, or at least 98% identity to SEQ ID NO:3 across 95% of SEQ ID NO:3, or at least 98% sequence identity to SEQ ID NO:3 across 100% of SEQ ID NO:3, or at least 99.5% sequence identity to SEQ ID NO:3 across 90% of SEQ ID NO:3, or at least 99.5% identity to SEQ ID NO:3 across 95% of SEQ ID NO:3, or at least 99.5% identity to SEQ ID NO:3 across 98% of SEQ ID NO:3, or at least 99.5% sequence identity to SEQ ID NO:3 across 100% of SEQ ID NO:3.

In certain embodiments, the bacterial strain for use in the invention has a plasmid with sequence identity to SEQ ID NO:4. In preferred embodiments, the bacterial strain for use in the invention has a plasmid with at least 90% sequence identity (e.g. at least 92%, 94%, 95%, 96%, 97%, 98%, 99% or 100% sequence identity) to SEQ ID NO:4 across at least 60% (e.g. at least 65%, 70%, 75%, 80%, 85%, 95%, 96%, 97%, 98%, 99% or 100%) of SEQ ID NO:4. For example, the bacterial strain for use in the invention may have a plasmid with at least 90% sequence identity to SEQ ID NO:4 across 70% of SEQ ID NO:4, or at least 90% sequence identity to SEQ ID NO:4 across 80% of SEQ ID NO:4, or at least 90% sequence identity to SEQ ID NO:4 across 90% of SEQ ID NO:4, or at least 90% sequence identity to SEQ ID NO:4 across 100% of SEQ ID NO:4, or at least 95% sequence identity to SEQ ID NO:4 across 70% of SEQ ID NO:4, or at least 95% sequence identity to SEQ ID NO:4 across 80% of SEQ ID NO:4, or at least 95% sequence identity to SEQ ID NO:4 across 90% of SEQ ID NO:4, or at least 95% sequence identity to SEQ ID NO:4 across 100% of SEQ ID NO:4, or at least 98% sequence identity to SEQ ID NO:4 across 70% of SEQ ID NO:4, or at least 98% sequence identity to SEQ ID NO:4 across 80% of SEQ ID NO:4, or at least 98% sequence identity to SEQ ID NO:4 across 90% of SEQ ID NO:4, or at least 98% sequence identity to SEQ ID NO:4 across 100% of SEQ ID NO:4.

In certain embodiments, the bacterial strain for use in the invention has a chromosome with sequence identity to SEQ ID NO:3 and a plasmid with sequence identity to SEQ ID NO:4.

In certain embodiments, the bacterial strain for use in the invention has a chromosome with sequence identity to SEQ ID NO:3, for example as described above, and a 16S rRNA sequence with sequence identity to any of SEQ ID NO:1 or 2, for example as described above, preferably with a 16s rRNA sequence that is at least 99% identical to SEQ ID NO:2, more preferably which comprises the 16S rRNA sequence of SEQ ID NO:2, and optionally comprises a plasmid with sequence identity to SEQ ID NO:4, as described above.

In certain embodiments, the bacterial strain for use in the invention has a chromosome with sequence identity to SEQ ID NO:3, for example as described above, and optionally comprises a plasmid with sequence identity to SEQ ID NO:4, as described above, and is effective for treating or preventing cancer.

In certain embodiments, the bacterial strain for use in the invention has a chromosome with sequence identity to SEQ ID NO:3, for example as described above, and a 16S rRNA sequence with sequence identity to any of SEQ ID NOs: 1 or 2, for example as described above, and optionally comprises a plasmid with sequence identity to SEQ ID NO:4, as described above, and is effective for treating or preventing cancer.

In certain embodiments, the bacterial strain for use in the invention has a 16s rRNA sequence that is at least 99%, 99.5% or 99.9% identical to the 16s rRNA sequence represented by SEQ ID NO: 2 (for example, which comprises the 16S rRNA sequence of SEQ ID NO:2) and a chromosome with at least 95% sequence identity to SEQ ID NO:3 across at least 90% of SEQ ID NO:3, and optionally comprises a plasmid with sequence identity to SEQ ID NO:4, as described above, and which is effective for treating or preventing cancer.

In certain embodiments, the bacterial strain for use in the invention has a 16s rRNA sequence that is at least 99%, 99.5% or 99.9% identical to the 16s rRNA sequence represented by SEQ ID NO: 2 (for example, which comprises the 16S rRNA sequence of SEQ ID NO:2) and a chromosome with at least 98% sequence identity (e.g. at least 99% or at least 99.5% sequence identity) to SEQ ID NO:3 across at least 98% (e.g. across at least 99% or at least 99.5%) of SEQ ID NO:3, and optionally comprises a plasmid with sequence identity to SEQ ID NO:4, as described above, and which is effective for treating or preventing cancer.

In certain embodiments, the bacterial strain for use in the invention is a *Enterococcus gallinarum* and has a 16s rRNA sequence that is at least 99%, 99.5% or 99.9% identical to the 16s rRNA sequence represented by SEQ ID NO: 2 (for example, which comprises the 16S rRNA sequence of SEQ ID NO:2) and a chromosome with at least 98% sequence identity (e.g. at least 99% or at least 99.5% sequence identity) to SEQ ID NO:3 across at least 98% (e.g. across at least 99% or at least 99.5%) of SEQ ID NO:3, and optionally comprises a plasmid with sequence identity to SEQ ID NO:4, as described above, and which is effective for treating or preventing cancer.

Alternatively, strains that are biotypes of the bacterium deposited under accession number NCIMB 42488 and that are suitable for use in the invention may be identified by using the accession number NCIMB 42488 deposit and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Enterococcus gallinarum* strains.

In certain embodiments, strains that are biotypes of the bacterium deposited under accession number NCIMB 42488 and that are suitable for use in the invention are strains that provide the same pattern as the bacterium deposited under accession number NCIMB 42488 when analyzed by amplified ribosomal DNA restriction analysis (ARDRA), for example when using Sau3AI restriction enzyme (for exemplary methods and guidance see, for example, [19]). Alternatively, biotype strains are identified as strains that have the same carbohydrate fermentation patterns as the bacterium deposited under accession number NCIMB 42488. In some embodiments, the carbohydrate fermentation pattern is determined using the API 50 CHL panel (bioMérieux). In some embodiments, the bacterial strain used in the invention is:

positive for fermentation of at least one of (e.g. at least 2, 3, 4, 5, 6, 7, 8, 9, 10, 11, 12, 13, 14, 15, 16, 17 or all of): L-arabinose, D-ribose, D-xylose, D-galactose, D-glucose, D-fructose, D-mannose, N-acetylglucosamine, amygdalin, arbutin, salicin, D-cellobiose, D-maltose, sucrose, D-trehalose, gentiobiose, D-tagatose and potassium gluconate; and/or intermediate for fermentation of at least one of (e.g. at least 2, 3, 4 or all of): D-mannitol, Methyl-αD-glycopyranoside, D-lactose, starch, and L-fucose;

preferably as determined by API 50 CHL analysis (preferably using the API 50 CHL panel from bioMérieux).

Other *Enterococcus gallinarum* strains that are useful in the compositions and methods of the invention, such as biotypes of the bacterium deposited under accession number NCIMB 42488, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to the bacterium deposited under accession number NCIMB 42488 may be useful in the invention. A useful strain will have comparable immune modulatory activity to the NCIMB 42488 strain. In particular, a biotype strain will elicit comparable effects on the cancer disease models to the effects shown in the Examples, which may be identified by using the culturing and administration protocols described in the Examples.

In some embodiments, the bacterial strain used in the invention is:

Positive for at least one of (e.g. at least 2, 3, 4, 5, 6, 7 or all of): mannose fermentation, glutamic acid decarboxylase, arginine arylamidase, phenylalanine arylamidase, pyroglutamic acid arylamidase, tyrosine arylamidase, histidine arylamidase and serine arylamidase; and/or Intermediate for at least one of (e.g. at least 2 or all of): β-galactosidase-6-phosphate, β-glucosidase and N-acetyl-β-glucosaminidase; and/or Negative for at least one of (e.g. at least 2, 3, 4, 5, 6 or all of): Raffinose fermentation, Proline arylamidase, Leucyl glycine arylamidase, Leucine arylamidase, Alanine arylamidase, Glycine arylamidase and Glutamyl glutamic acid arylamidase, preferably as determined by an assay of carbohydrate, amino acid and nitrate metabolism, and optionally an assay of alkaline phosphatase activity, more preferably as determined by Rapid ID 32A analysis (preferably using the Rapid ID 32A system from bioMérieux).

In some embodiments, the bacterial strain used in the invention is:

Negative for at least one of (e.g. at least 2, 3, or all 4 of) glycine arylamidase, raffinose fermentation, proline arylamidase, and leucine arylamidase, for example, as determined by an assay of carbohydrate, amino acid and nitrate metabolism, preferably as determined by Rapid ID 32A analysis (preferably using the Rapid ID 32A system from bioMérieux); and/or Intermediate positive for fermentation of L-fucose, preferably as determined by API 50 CHL analysis (preferably using the API 50 CHL panel from bioMérieux).

In some embodiments, the bacterial strain used in the invention is an extracellular ATP producer, for example one which produces 6-6.7 ng/µl (for example, 6.1-6.6 ng/µl or 6.2-6.5 ng/µl or 6.33±0.10 ng/µl) of ATP as measured using the ATP Assay Kit (Sigma-Aldrich, MAK190). Bacterial extracellular ATP can have pleiotropic effects including activation of T cell-receptor mediated signalling (Schenk et al., 2011), promotion of intestinal Th17 cell differentiation (Atarashi et al., 2008) and induction of secretion of the pro-inflammatory mediator IL-1β by activating the NLRP3 inflammasome (Karmarkar et al., 2016). Accordingly, a bacterial strain which is an extracellular ATP producer is useful for treating or preventing cancer.

In some embodiments, the bacterial strain for use in the invention comprises one or more of the following three genes: Mobile element protein; Xylose ABC transporter, permease component; and FIG00632333: hypothetical protein. For example, in certain embodiments, the bacterial strain for use in the invention comprises genes encoding Mobile element protein and Xylose ABC transporter, permease component; Mobile element protein and FIG00632333: hypothetical protein; Xylose ABC transporter, permease component and FIG00632333: hypothetical protein; or Mobile element protein, Xylose ABC transporter, permease component, and FIG00632333: hypothetical protein.

A particularly preferred strain of the invention is the *Enterococcus gallinarum* strain deposited under accession number NCIMB 42488. This is the exemplary MRX518 strain tested in the examples and shown to be effective for treating disease. Therefore, the invention provides a cell, such as an isolated cell, of the *Enterococcus gallinarum* strain deposited under accession number NCIMB 42488, or a derivative thereof. The invention also provides a composition comprising a cell of the *Enterococcus gallinarum* strain deposited under accession number NCIMB 42488, or a derivative thereof. The invention also provides a biologically pure culture of the *Enterococcus gallinarum* strain deposited under accession number NCIMB 42488. The invention also provides a cell of the *Enterococcus gallinarum* strain deposited under accession number NCIMB 42488, or a derivative thereof, for use in therapy, in particular for the diseases described herein. A derivative of the strain deposited under accession number NCIMB 42488 may be a daughter strain (progeny) or a strain cultured (subcloned) from the original.

A derivative of a strain of the invention may be modified, for example at the genetic level, without ablating the biological activity. In particular, a derivative strain of the invention is therapeutically active. A derivative strain will have comparable immune modulatory activity to the original NCIMB 42488 strain. In particular, a derivative strain will elicit comparable effects on the cancer disease models to the effects shown in the Examples, which may be identified by using the culturing and administration protocols described in the Examples. A derivative of the NCIMB 42488 strain will generally be a biotype of the NCIMB 42488 strain.

References to cells of the *Enterococcus gallinarum* strain deposited under accession number NCIMB 42488 encompass any cells that have the same safety and therapeutic efficacy characteristics as the strains deposited under accession number NCIMB 42488, and such cells are encompassed by the invention. Thus, in some embodiments, reference to cells of the *Enterococcus gallinarum* strain deposited under accession number NCIMB 42488 refers only to the MRX518 strain deposited under NCIMB 42488 and does not refer to a bacterial strain that was not deposited under NCIMB 42488. In some embodiments, reference to cells of the *Enterococcus gallinarum* strain deposited under accession number NCIMB 42488 refers to cells that have the same safety and therapeutic efficacy characteristics as the strains deposited under accession number NCIMB 42488, but which are not the strain deposited under NCIMB 42488.

In preferred embodiments, the bacterial strains in the compositions of the invention are viable and capable of partially or totally colonizing the intestine.

Treating Cancer

In preferred embodiments, the compositions of the invention are for use in treating or preventing cancer. The examples demonstrate that administration of the compositions of the invention can lead to a reduction in tumor growth in a number of tumor models.

In certain embodiments, treatment with the compositions of the invention results in a reduction in tumor size or a reduction in tumor growth. In certain embodiments, the compositions of the invention are for use in reducing tumor size or reducing tumor growth. The compositions of the invention may be effective for reducing tumor size or growth. In certain embodiments, the compositions of the invention are for use in subjects with solid tumors. In certain embodiments, the compositions of the invention are for use in reducing or preventing angiogenesis in the treatment of cancer. The compositions of the invention may have an effect on the immune or inflammatory systems, which have central roles in angiogenesis. In certain embodiments, the compositions of the invention are for use in preventing metastasis.

In certain embodiments, the compositions of the invention are for use in treating or preventing breast cancer. The examples demonstrate that the compositions of the invention may be effective for treating breast cancer. In certain embodiments, the compositions of the invention are for use in reducing tumor size, reducing tumor growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The examples demonstrate that the compositions of the invention may be effective for treating lung cancer. In certain embodiments, the compositions of the invention are for use in reducing tumor size, reducing tumor growth, or reducing angiogenesis in the treatment of lung cancer. In preferred embodiments the cancer is lung carcinoma.

In certain embodiments, the compositions of the invention are for use in treating or preventing liver cancer. The examples demonstrate that the compositions of the invention may be effective for treating liver cancer. In certain embodiments, the compositions of the invention are for use in reducing tumor size, reducing tumor growth, or reducing angiogenesis in the treatment of liver cancer. In preferred embodiments the cancer is hepatoma (hepatocellular carcinoma).

In certain embodiments, the compositions of the invention are for use in treating or preventing colon cancer. The examples demonstrate that the compositions of the invention have an effect on colon cancer cells and may be effective for treating colon cancer. In certain embodiments, the compositions of the invention are for use in reducing tumor size, reducing tumor growth, or reducing angiogenesis in the treatment of colon cancer. In preferred embodiments the cancer is colorectal adenocarcinoma.

In some embodiments, the cancer is of the intestine. In some embodiments, the cancer is of a part of the body which is not the intestine. In some embodiments, the cancer is not cancer of the intestine. In some embodiments, the cancer is not colorectal cancer. In some embodiments, the cancer is not cancer of the small intestine. In some embodiments, the treating or preventing occurs at a site other than at the intestine. In some embodiments, the treating or preventing occurs at the intestine and also at a site other than at the intestine.

In certain embodiments, the compositions of the invention are for use in treating or preventing carcinoma. The examples demonstrate that the compositions of the invention may be effective for treating numerous types of carcinoma. In certain embodiments, the compositions of the invention are for use in treating or preventing non-immunogenic cancer. The examples demonstrate that the compositions of the invention may be effective for treating non-immunogenic cancers.

The therapeutic effects of the compositions of the invention on cancer may be mediated by a pro-inflammatory mechanism. Examples 2, 4 and 5 demonstrate that the expression of a number of pro-inflammatory cytokines may be increased following administration of MRX518. Inflammation can have a cancer-suppressive effect [20] and pro-inflammatory cytokines such as TNFα are being investigated as cancer therapies [21]. The up-regulation of genes such as TNF shown in the examples may indicate that the compositions of the invention may be useful for treating cancer via a similar mechanism. The up-regulation of CXCR3 ligands (CXCL9, CXCL10) and IFNγ-inducible genes (IL-32) may indicate that the compositions of the invention elicit an IFNγ-type response. IFNγ is a potent macrophage-activating factor that can stimulate tumirocidal activity [22], and CXCL9 and CXCL10, for example, also have anti-cancer effects [23-25]. Therefore, in certain embodiments, the compositions of the invention are for use in promoting inflammation in the treatment of cancer. In preferred embodiments, the compositions of the invention are for use in promoting Th1 inflammation in the treatment of cancer. Th1 cells produce IFNγ and have potent anti-cancer effects [20]. In certain embodiments, the compositions of the invention are for use in treating an early-stage cancer, such as a cancer that has not metastasized, or a stage 0 or stage 1 cancer. Promoting inflammation may be more effective against early-stage cancers [20]. In certain embodiments, the compositions of the invention are for use in promoting inflammation to enhance the effect of a second anti-cancer agent. In certain embodiments, the treatment or prevention of cancer comprises increasing the level of expression of one or more cytokines. For example, in certain embodiments, the treatment or prevention of cancer comprises increasing the level of expression of one or more of IL-1β, IL-6 and TNF-α, for example, IL-1β and IL-6, IL-1β and TNF-α, IL-6 and TNF-α or all three of IL-1β, IL-6 and TNF-α. Increases in levels of expression of any of IL-1β, IL-6 and TNF-α are known to be indicative of efficacy in treatment of cancer.

Examples 4 and 5 demonstrate that when a bacterial strain as described herein is used in combination with lipopolysaccharide (LPS), there is a synergistic increase in IL-1β. LPS is known to elicit a pro-inflammatory effect. Thus, in certain embodiments, the treatment or prevention comprises using a bacterial strain as described herein in combination with an agent that upregulates IL-1β. In certain embodiments, the treatment or prevention comprises using a bacterial strain as described herein in combination with LPS. Accordingly, a composition of the invention may additionally comprise an agent that upregulates IL-1β. Accordingly, a composition of the invention may additionally comprise LPS.

In certain embodiments, the compositions of the invention are for use in treating a subject that has previously received chemotherapy. In certain embodiments, the compositions of the invention are for use in treating a subject that has not tolerated a chemotherapy treatment. The compositions of the invention may be particularly suitable for such subjects. In some instances, a subject is in need thereof.

In certain embodiments, the compositions of the invention are for preventing relapse. The compositions of the invention may be suitable for long-term administration. In certain embodiments, the compositions of the invention are for use in preventing progression of cancer.

In certain embodiments, the compositions of the invention are for use in treating non-small-cell lung carcinoma. In certain embodiments, the compositions of the invention are for use in treating small-cell lung carcinoma. In certain embodiments, the compositions of the invention are for use in treating squamous-cell carcinoma. In certain embodiments, the compositions of the invention are for use in treating adenocarcinoma. In certain embodiments, the compositions of the invention are for use in treating glandular tumors, carcinoid tumors, or undifferentiated carcinomas.

In certain embodiments, the compositions of the invention are for use in treating hepatoblastoma, cholangiocarcinoma, cholangiocellular cystadenocarcinoma or liver cancer resulting from a viral infection.

In certain embodiments, the compositions of the invention are for use in treating invasive ductal carcinoma, ductal carcinoma in situ or invasive lobular carcinoma.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising a bacterial strain of the species *Enterococcus gallinarum* and an anticancer agent. In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy (ipilimumab, BMS); Keytruda (pembrolizumab, Merck); Opdivo (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin (dinutuximab, United Therapeutics Corporation); Blincyto (blinatumomab, Amgen); Cyramza (ramucirumab, Eli Lilly); Gazyva (obinutuzumab, Roche/Biogen); Kadcyla (ado-trastuzumab emtansine, Roche/Genentech); Perjeta (pertuzumab, Roche/Genentech); Adcetris (brentuximab vedotin, Takeda/Millennium); Arzerra (ofatumumab, GSK); Vectibix (panitumumab, Amgen); Avastin (bevacizumab, Roche/Genentech); Erbitux (cetuximab, BMS/Merck); Bexxar (tositumomab-I131, GSK); Zevalin (ibritumomab tiuxetan, Biogen); Campath (alemtuzumab, Bayer); Mylotarg (gemtuzumab ozogamicin, Pfizer); Herceptin (trastuzumab, Roche/Genentech); Rituxan (rituximab, Genentech/Biogen); volociximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562 (AZ/MedImmune); AV-380 (AVEO); AV203 (AVEO); AV299 (AVEO); BAY79-4620 (Bayer); Anetumab ravtansine (Bayer); vantictumab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vantictumab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obintuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor);

Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Ad1 (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1 (Genelux); T-VEC (Amgen); G207 (Medigene); HF10 (Takara Bio); SEPREHVIR (HSV1716, Virttu Biologics); OrienX010 (OrienGene Biotechnology); Reolysin (Oncolytics Biotech); SVV-001 (Neotropix); Cacatak (CVA21, Viralytics); Alimta (Eli Lilly), cisplatin, oxaliplatin, irinotecan, folinic acid, methotrexate, cyclophosphamide, 5-fluorouracil, Zykadia (Novartis), Tafinlar (GSK), Xalkori (Pfizer), Iressa (AZ), Gilotrif (Boehringer Ingelheim), Tarceva (Astellas Pharma), Halaven (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan (BMS); Oncovin (Eli Lilly); Adriamycin (Pfizer); Gemzar (Eli Lilly); Xeloda (Roche); Ixempra (BMS); Abraxane (Celgene); Trelstar (Debiopharm); Taxotere (Sanofi); Nexavar (Bayer); IMMU-132 (Immunomedics); E7449 (Eisai); Thermodox (Celsion); Cometriq (Exellxis); Lonsurf (Taiho Pharmaceuticals); Camptosar (Pfizer); UFT (Taiho Pharmaceuticals); and TS-1 (Taiho Pharmaceuticals).

In some embodiments, the one or more bacterial strains having a 16s rRNA sequence that is at least 95% identical to SEQ ID NO:2, for example which is an *Enterococcus gallinarum*, is/are the only therapeutically active agent(s) in a composition of the invention. In some embodiments, the bacterial strain(s) in the composition is/are the only therapeutically active agent(s) in a composition of the invention.

Modes of Administration

Preferably, the compositions of the invention are to be administered to the gastrointestinal tract in order to enable delivery to and/or partial or total colonization of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the subject's gut microbiota. Treatment may be repeated if delivery of and/or partial or total colonization with the strain of the invention is not achieved such that efficacy is not observed, or treatment may be ceased if delivery and/or partial or total colonization is successful and efficacy is observed.

In certain embodiments, the composition of the invention may be administered to a pregnant animal, for example a mammal such as a human in order to reduce the likelihood of cancer developing in her child in utero and/or after it is born.

The compositions of the invention may be administered to a subject that has been diagnosed with cancer, or that has been identified as being at risk of a cancer. The compositions may also be administered as a prophylactic measure to prevent the development of cancer in a healthy subject.

The compositions of the invention may be administered to a subject that has been identified as having an abnormal gut microbiota. For example, the subject may have reduced or absent colonization by *Enterococcus gallinarum*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilized bacteria. Lyophilization of bacteria is a well-established procedure and relevant guidance is available in, for example, references [26-28].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of partially or totally colonizing the intestine. For example, in some embodiments, the bacterial strain in the composition of the invention is viable and capable of partially or totally colonizing the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [29] and [30].

The composition may be administered orally and may be in the form of a tablet, capsule or powder. Encapsulated products are preferred because *Enterococcus gallinarum* are anaerobes. Other ingredients (such as vitamin C, for example), may be included as oxygen scavengers and prebiotic substrates to improve the delivery and/or partial or total colonization and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a subject. A therapeutically effective amount of a bacterial strain may be sufficient to result in delivery to and/or partial or total colonization of the subject's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1 \times 10^8$ to about $1 \times 10^{10}$ CFU/g. The dose may be, for example, 1 g, 3 g, 5 g, and 10 g of said composition.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [31]. Acceptable carriers or diluents for therapeutic use are well known in the pharmaceutical art and are described, for example, in reference [32]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilizing agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavoring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated with a nutritious product such as a milk-food product or a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yogurt, curdled milk, curd, sour milk, sour whole milk, butter milk and other sour milk products. Another important group includes milk beverages, such as whey beverages, fermented milks, condensed milks, infant or baby milks; flavored milks, ice cream; milk-containing food such as sweets.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism. Thus, in some embodiments, the invention provides a composition comprising one or more strains from the species *Enterococcus gallinarum*, which does not contain bacteria from any other species or which comprises only de minimis or biologically irrelevant amounts of bacteria from another species for use in therapy. In some embodiments, the composition consists essentially of *Enterococcus gallinarum*.

In some embodiments, the compositions of the invention comprise more than one bacterial strain or species. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. In some embodiments, the compositions of the invention comprise more than one species from within the same genus (e.g. more than 1, 2, 3, 4, 5, 6, 7, 8, 9, 10, 12, 15, 17, 20, 23, 25, 30, 35 or 40 species), and, optionally, do not contain bacteria from any other genus. In some embodiments, the compositions of the invention comprise less than 50 species from within the same genus (e.g. less than 50, 45, 40, 35, 30, 25, 20, 15, 12, 10, 8, 7, 6, 5, 4 or 3 species), and, optionally, do not contain bacteria from any other genus. In some embodiments, the compositions of the invention comprise 1-50, 1-40, 1-30, 1-20, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 species from within the same genus and, optionally, do not contain bacteria from any other genus. The invention comprises any combination of the foregoing.

In some embodiments, the composition comprises a microbial consortium. For example, in some embodiments, the composition comprises the bacterial strain having a 16s rRNA sequence that is at least 95% identical to SEQ ID NO:2, for example, which is an *Enterococcus gallinarum*, as part of a microbial consortium. For example, in some embodiments, the bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain having a 16s rRNA sequence that is at least 95% identical to SEQ ID NO:2, for example, which is an *Enterococcus gallinarum*, in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans, e.g. two different human infants. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRX518, but which is not MRX518 deposited as NCIMB 42488, or which is not an *Enterococcus gallinarum*.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human infant faeces. In some embodiments in which the composition of the invention comprises more than one bacterial strain, all of the bacterial strains are obtained from human infant faeces or if other bacterial strains are present they are present only in de minimis amounts. The bacteria may have been cultured subsequent to being obtained from the human infant faeces and being used in a composition of the invention.

The compositions for use in accordance with the invention may or may not require marketing approval.

In certain embodiments, the invention provides the above pharmaceutical composition, wherein said bacterial strain is lyophilized. In certain embodiments, the invention provides the above pharmaceutical composition, wherein said bacterial strain is spray dried. In certain embodiments, the invention provides the above pharmaceutical composition, wherein the bacterial strain is lyophilized or spray dried and wherein it is live. In certain embodiments, the invention provides the above pharmaceutical composition, wherein the bacterial strain is lyophilized or spray dried and wherein it is viable. In certain embodiments, the invention provides the above pharmaceutical composition, wherein the bacterial strain is lyophilized or spray dried and wherein it is capable of partially or totally colonizing the intestine. In certain embodiments, the invention provides the above pharmaceutical composition, wherein the bacterial strain is lyophilized or spray dried and wherein it is viable and capable of partially or totally colonizing the intestine.

In some cases, the lyophilized or spray dried bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is breast cancer. In preferred embodiments the cancer is mammary carcinoma. In preferred embodiments the cancer is stage IV breast cancer.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is lung cancer. In preferred embodiments the cancer is lung carcinoma.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is liver cancer. In preferred embodiments the cancer is hepatoma (hepatocellular carcinoma).

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is colon cancer. In preferred embodiments the cancer is colorectal adenocarcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is carcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is a non-immunogenic cancer.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of non-small-cell lung carcinoma, small-cell lung carcinoma, squamous-cell carcinoma, adenocarcinoma, glandular tumors, carcinoid tumors undifferentiated carcinomas.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of hepatoblastoma, cholangiocarcinoma, cholangiocellular cystadenocarcinoma or liver cancer resulting from a viral infection.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of invasive ductal carcinoma, ductal carcinoma in situ or invasive lobular carcinoma.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

In certain embodiments, the invention provides the above pharmaceutical composition, wherein the amount of the bacterial strain is from about $1\times10^3$ to about $1\times10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein when the composition is stored in a sealed container at about 4° C. or about 25° C. and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [33]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strains for use in the present invention can be cultured using standard microbiology techniques as detailed in, for example, references [34-36].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4 \cdot 7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing cancer. This is likely to be a result of the effect that the bacterial strains of the invention have on the host immune system. Therefore, the compositions of the invention may also be useful for preventing cancer, when administered as vaccine compositions. In certain such embodiments, the bacterial strains of the invention are viable. In certain such embodiments, the bacterial strains of the invention are capable of partially or totally colonizing the intestine. In certain such embodiments, the bacterial strains of the invention are viable and capable of partially or totally colonizing the intestine. In other certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [37] and [38-44], etc.

A subject treated by a method described herein, or by contact with or administration of a composition described herein can be a mammalian subject who can be a human subject, a non-human primate, a canine mammal, a felid mammal or any other mammal. A subject maybe a patient who is a mammalian patient for instance, a human patient, a non-human primate, a canine mammal, a felid mammal or any other mammalian patient.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref [45]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref [46].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in Mouse Models of Cancer

Summary

This study tested the efficacy of compositions comprising an exemplary bacterial strain according to the invention in four tumor models.

Materials

Test Substance—

Bacterial strain #MRX518.

Reference Substance—

Anti-CTLA-4 antibody (clone: 9H10, catalog: BE0131, isotype: Syrian Hamster IgG1, Bioxcell).

Test and Reference Substances Vehicles—

Bacterial culture medium (Yeast extract, Casitone, Fatty Acid medium (YCFA)). Each day of injection to mice, antibody was diluted with PBS (ref: BE14-516F, Lonza, France).

Treatment Doses—

Bacteria: $2\times10^8$ in 200 µL. The a-CTLA-4 was injected at 10 mg/kg/inj. Anti-CTLA-4 was administered at a dose volume of 10 mL/kg/adm (i.e. for one mouse weighing 20 g, 200 µL of test substance will be administered) according to the most recent body weight of mice.

Routes of Administration—

Bacterial inoculum was administered by oral gavage (per os, PO) via a cannula. Cannulas were decontaminated every day. Anti-CTLA-4 was injected into the peritoneal cavity of mice (Intraperitoneally, IP).

Culture Conditions of Bacterial Strain—

The culture conditions for the bacterial strain were as follows:

Pipette 10 mL of YCFA (from the prepared 10 mL E&O lab bottles) into Hungate tubes Seal the tubes and flush with $CO_2$ using a syringe input and exhaust system Autoclave the Hungate tubes When cooled, inoculate the Hungate tubes with 1 mL of the glycerol stocks Place the tubes in a static 37° C. incubator for about 16 hours.

The following day, take 1 mL of this subculture and inoculate 10 mL of YCFA (pre-warmed flushed Hungate tubes again, all in duplicate)

Place them in a static 37° C. incubator for 5 to 6 h

Cancer Cell Line and Culture Conditions—

The cell lines that were used are detailed in the table below:

| Cell line | Type | Mouse strain | Origin |
|---|---|---|---|
| EMT-6 | Breast carcinoma | BALB/c | ATCC |
| LL/2 (LLC1) | Lung carcinoma | C57BL/6 | ATCC CRL1642 |
| Hepa1-6 | Hepatocellular carcinoma | C57BL/6 | IPSEN INNOVATION |

The EMT-6 cell line was established from a transplantable murine mammary carcinoma that arose in a BALB/cCRGL mouse after implantation of a hyperplastic mammary alveolar nodule [47].

The LL/2 (LLC1) cell line was established from the lung of a C57BL mouse bearing a tumor resulting from an implantation of primary Lewis lung carcinoma [48].

The Hepa 1-6 cell line is a derivative of the BW7756 mouse hepatoma that arose in a C57/L mouse [49].

Cell Culture Conditions—

All cell lines were grown as monolayer at 37° C. in a humidified atmosphere (5% $CO_2$, 95% air). The culture medium and supplement are indicated in the table below:

| Cell line | Culture medium | Supplement |
|---|---|---|
| EMT6 | RPMI 1640 containing 2 mM L-glutamine (ref: BE12-702F, Lonza) | 10% fetal bovine serum (ref: #3302, Lonza) |
| LL/2 (LLC1) | RPMI 1640 containing 2 mM L-glutamine (ref: BE12-702F, Lonza) | 10% fetal bovine serum (ref: #3302, Lonza) |
| Hepa1-6 | DMEM (ref: 11960-044, Gibco) | 10% fetal bovine serum (ref: #3302, Lonza) 2 mM L-Glutamine penicillin-streptomycin (Sigma G-6784) |

For experimental use, adherent tumor cells were detached from the culture flask by a 5 minute treatment with trypsin-versene (ref: BE17-161E, Lonza), in Hanks' medium without calcium or magnesium (ref: BE10-543F, Lonza) and neutralized by addition of complete culture medium. The cells were counted in a hemocytometer and their viability will be assessed by 0.25% trypan blue exclusion assay.

Use of Animals—

Healthy female Balb/C (BALB/cByJ) mice, of matching weight and age, were obtained from CHARLES RIVER (L'Arbresles) for the EMT6 model experiments.

Healthy female C57BL/6 (C57BL16J) mice, of matching weight and age, were obtained from CHARLES RIVER (L'Arbresles) for the LL/2(LLC1) and the Hepa1-6 model experiments.

Animals were maintained in SPF health status according to the FELASA guidelines, and animal housing and experimental procedures according to the French and European Regulations and NRC Guide for the Care and Use of Laboratory Animals were followed [50,51]. Animals were maintained in housing rooms under controlled environmental conditions: Temperature: 22±2° C., Humidity 55±10%, Photoperiod (12 h light/12 h dark), HEPA filtered air, 15 air exchanges per hour with no recirculation. Animal enclosures were provided with sterile and adequate space with bedding material, food and water, environmental and social enrichment (group housing) as described: 900 $cm^2$ cages (ref: green, Tecniplast) in ventilated racks, Epicea bedding (SAFE), 10 kGy Irradiated diet (A04-10, SAFE), Complete food for immuno-competent rodents—R/M-H Extrudate, water from water bottles.

Experimental Design and Treatments

Antitumor Activity, EMT6 Model

Treatment schedule—The start of first dosing was considered as D0. On D0, non-engrafted mice were randomized according to their individual body weight into groups of 9/8 using Vivo Manager® software (Biosystemes, Couternon, France). On D0, the mice received vehicle (culture medium) or bacterial strain. On D14, all mice were engrafted with EMT-6 tumor cells as described below. On D24, mice from the positive control group received anti-CTLA-4 antibody treatments.

The treatment schedule is summarized in the table below:

| Group | No. Animals | Treatment | Dose | Route | Treatment Schedule |
|---|---|---|---|---|---|
| 1 | 8 | Untreated | — | — | — |
| 2 | 8 | Vehicle (media) | — | PO | Q1Dx42 |
| 3 | 9 | Bacterial strain #1 (MRX518) | $2 \times 10^8$ bacteria | PO | Q1Dx42 |
| 4 | 8 | Anti-CTLA4 | 10 mg/kg | IP | TWx2 |

The monitoring of animals was performed as described below.

Induction of EMT6 tumors in animals—On D14, tumors were induced by subcutaneous injection of $1 \times 10^6$ EMT-6 cells in 200 μL RPMI 1640 into the right flank of mice.

Euthanasia—Each mouse was euthanized when it reached a humane endpoint as described below, or after a maximum of 6 weeks post start of dosing.

Antitumor Activity, LL/2 (LLC1) Model

Treatment schedule—The start of first dosing was considered as D0. On D0, non-engrafted mice were randomized according to their individual body weight into 7 groups of 9/8 using Vivo Manager® software (Biosystemes, Couternon, France). On D0, the mice will received vehicle (culture medium) or bacterial strain. On D14, all mice were engrafted with LL/2 tumor cells as described below. On D27, mice from the positive control group received anti-CTLA-4 antibody treatments.

The treatment schedule is summarized in the table below:

| Group | No. Animals | Treatment | Dose | Route | Treatment Schedule |
|---|---|---|---|---|---|
| 1 | 8 | Untreated | — | — | — |
| 2 | 9 | Vehicle (media) | — | PO | Q1Dx42 |
| 3 | 9 | Bacterial strain #1 (MRX518) | $2 \times 10^8$ bacteria | PO | Q1Dx42 |
| 4 | 8 | Anti-CTLA4 | 10 mg/kg | IP | TWx2 |

The monitoring of animals was performed as described below.

Induction of LL/2 (LLC1) tumors in animals—On D14, tumors were induced by subcutaneous injection of $1 \times 10^6$ LL/2 (LLC1) cells in 200 μL RPMI 1640 into the right flank of mice.

Euthanasia—Each mouse was euthanized when it reached a humane endpoint as described below, or after a maximum of 6 weeks post start of dosing.

Antitumor Activity, Hepa1-6 Model

Treatment schedule—The start of first dosing was considered as D0. On D0, non-engrafted mice were randomized according to their individual body weight into 7 groups of 9 using Vivo Manager® software (Biosystemes, Couternon, France). On D0, the mice received vehicle (culture medium) or bacterial strain. On D14, all mice were engrafted with Hepa 1-6 tumor cells as described below. On D16, mice from the positive control group received anti-CTLA-4 antibody treatments.

The treatment schedule is summarized in the table below:

| Group | No. Animals | Treatment | Dose | Route | Treatment Schedule |
|---|---|---|---|---|---|
| 1 | 9 | Untreated | — | — | — |
| 2 | 9 | Vehicle (media) | — | PO | Q1Dx42 |
| 6 | 9 | Bacterial strain #4 (MRX518) | $2 \times 10^8$ bacteria | PO | Q1Dx42 |
| 7 | 9 | Anti-CTLA4 | 10 mg/kg | IP | TWx2 |

The monitoring of animals was performed as described below.

Orthotopic induction of Hepa 1-6 tumor cells in animals by intrasplenic injection—On D14, one million ($1 \times 10^6$) Hepa 1-6 tumor cells in 50 μL RPMI 1640 medium were transplanted via intra-splenic injection into mice. Briefly, a small left subcostal flank incision was made and the spleen was exteriorized. The spleen was exposed on a sterile gauze pad, and injected under visual control with the cell suspension with a 27-gauge needle. After the cell inoculation, the spleen was excised.

Euthanasia—Each mouse was euthanized when it reached a humane endpoint as described in section below, or after a maximum of 6 weeks post start of dosing.

Evaluation of tumor burden at euthanasia—At the time of termination, livers were collected and weighed.

Animal Monitoring

Clinical monitoring—The length and width of the tumor was measured twice a week with callipers and the volume of the tumor was estimated by this formula [52]:

$$\text{Tumor volume} = \frac{width^2 \times length}{2}$$

Humane endpoints [53]: Signs of pain, suffering or distress: pain posture, pain face mask, behaviour; Tumor exceeding 10% of normal body weight, but non-exceeding 2000 mm$^3$; Tumors interfering with ambulation or nutrition; Ulcerated tumor or tissue erosion; 20% body weight loss remaining for 3 consecutive days; Poor body condition, emaciation, cachexia, dehydration; Prolonged absence of voluntary responses to external stimuli; Rapid laboured breathing, anaemia, significant bleeding; Neurologic signs: circling, convulsion, paralysis; Sustained decrease in body temperature; Abdominal distension.

Anaesthesia—Isoflurane gas anesthesia were used for all procedures: surgery or tumor inoculation, i.v. injections, blood collection. Ketamine and Xylazine anesthesia were used for stereotaxia surgical procedure.

Analgesia—Carprofen or multimodal carprofen/buprenorphine analgesia protocol were adapted to the severity of surgical procedure. Non-pharmacological care was provided for all painful procedures. Additionally, pharmacological care not interfering with studies (topic treatment) were provided at the recommendation of the attending veterinarian.

Euthanasia—Euthanasia of animals was performed by gas anesthesia over-dosage (Isoflurane) followed by cervical dislocation or exsanguination.

Results

Antitumor Activity, EMT6 Model

The results are shown in FIG. 1. Treatment with an exemplary bacterial strain of the invention led to a clear reduction in tumor volume relative to both the negative controls. The positive control also led to a reduction in tumor volume, as would be expected.

Antitumor Activity, LL/2 (LLC1) Model

Figure 2:
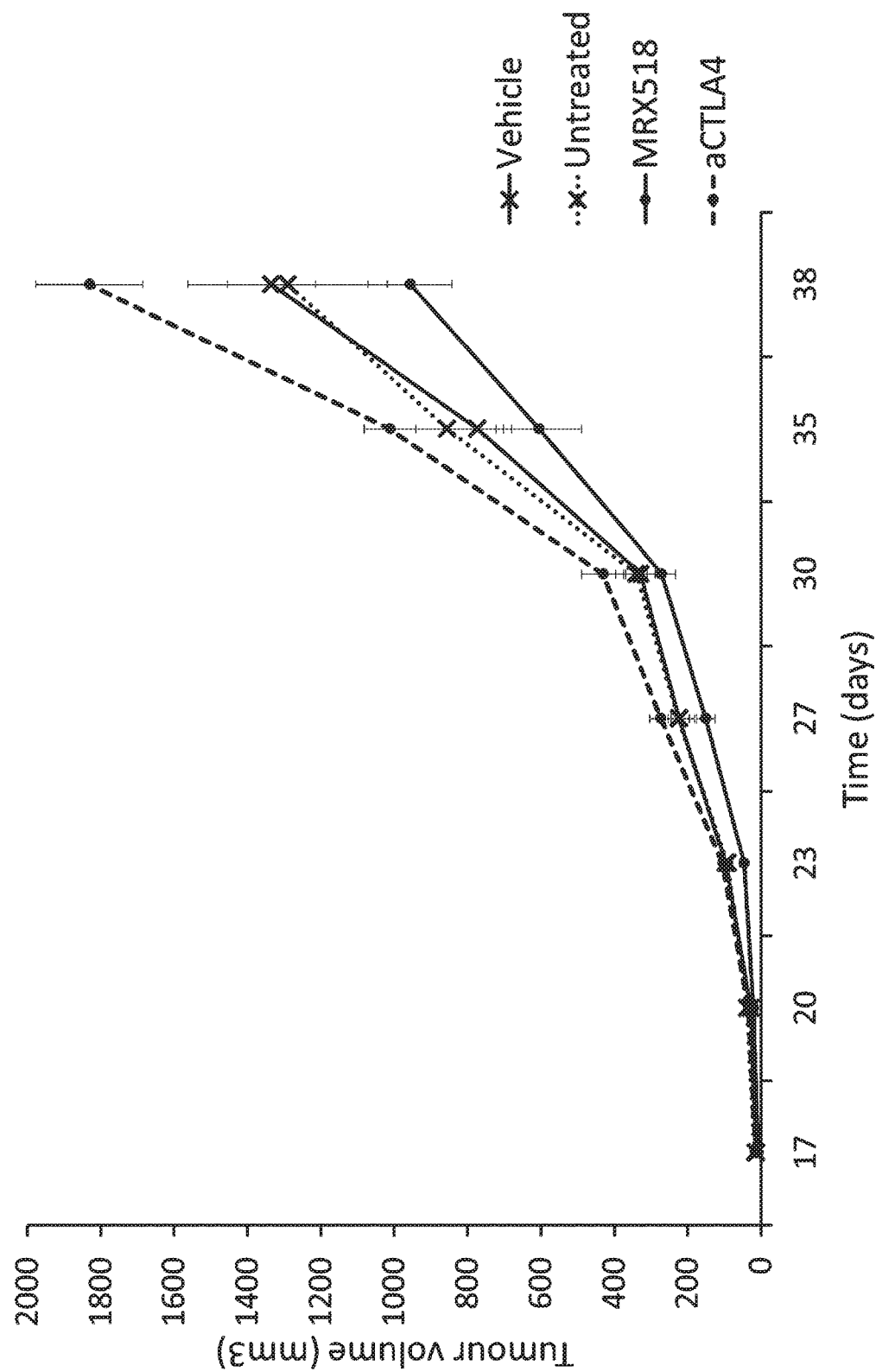
FIG. 2: Mouse model of lung cancer-tumor volume.

The results are shown in FIG. 2. Treatment with an exemplary bacterial strain of the invention led to a clear reduction in tumor volume relative to both the negative controls.

Antitumor Activity, Hepa1-6 Model

The results are shown in FIG. 3. The untreated negative control does not appear as would be expected, because liver weight was lower in this group than the other groups. However, the vehicle negative control and the positive control groups both appear as would be expected, because mice treated with vehicle alone had larger livers than mice treated with anti-CTLA4 antibodies, reflecting a greater tumor burden in the vehicle negative control group. Treatment with an exemplary bacterial strain of the invention led to a clear reduction in liver weight (and therefore tumor burden) relative to the mice in the vehicle negative control group.

These data indicate that strain MRX518 may be useful for treating or preventing cancer, and in particular for reducing tumor volume in breast, lung and liver cancers.

Example 2—PCR Gene Analysis

A pure culture of bacteria MRX518 was studied in a PCR gene analysis. There were two arms to the experiment: 1) MRX518 was co-cultured with human colonic cells (CaCo2) to investigate the effects of the bacteria on the host, and 2) MRX518 was co-cultured on CaCo2 cells that were stimulated with IL1 to mimic the effect of the bacteria in an inflammatory environment. The effects in both scenarios were evaluated through gene expression analysis. The results are shown below:

| Gene | Fold change | Function |
| --- | --- | --- |
| CXCL3 | 28412.73 | CXCR2 ligand, |
| CXCL2 | 135.42 | CXCR2 ligand, 90% homology with CXCL1. |
| CXCL9 | 34.76 | CXCR3 ligand, primarily thought of as Th1 cell chemoattractant (inducible by IFN-g) |
| IL8 | 31.81 | Cytokine, chemoattractant (especially neutrophils), many receptors including CXCR1 and CXCR2/ |
| CXCL1 | 16.48 | CXCR2 ligand, stimulates cell proliferation as well as migration, overexpression is neuroprotective in EAE. |
| CD40 | 14.33 | Co-stimulatory molecule, route of T cell dependent DC activation. |
| TNF | 13.50 | Major proinflammatory cytokine |
| IL17C | 12.18 | Promotes antibacterial response from epthielium, synergistic with IL-22, |
| CXCL10 | 10.66 | Close homology with CXCL9, think also CXCR3 ligand |
| HSPA1B | 10.19 | Heat shock protein |
| NFKBIA | 8.87 | NFkB signalling; PI3K |
| JUN | 7.61 | Antibacterial response; GPCR signalling. |
| TNFAIP3 | 6.63 | TNF signalling |
| DUSP1 | 6.36 | Anti-inflammatory phosphatase, inactivates MAPKs |
| JUNB | 5.36 | Transcription factor, JAK-STAT signalling |
| BIRC3 | 4.86 | Adherens junctions, tight junctions |
| DUSP2 | 4.59 | Anti-inflammatory, inactivates MAPK. |
| IL32 | 4.29 | Proinflammatory cytokine, induced by IFN-g, IL-18 |
| DUSP5 | 3.12 | Anti-inflammatory, inactivates MAPK |
| FOS | 3.03 | Transcription factors, TLR signalling, forms part of AP-1 |
| GADD45B | 2.89 | Cell growth and proliferation |
| CLDN4 | 2.61 | Tight junctions |
| ADM | 2.57 | NFkB signalling |
| KLF10 | 2.49 | Cell arrest, TGF-b singllaing. |
| DEFB4A | −2.34 | Antimicrobial peptide |
| APBA1 | −2.53 | Signalling |
| IGFBP1 | −2.72 | Signalling pathway |
| IL28B | −2.73 | IFN-lambda, antiviral immune defence, |
| IL10 | −3.38 | Anti-inflammatory cytokine |
| NR4A1 | −5.57 | Nuclear receptor, anti-inflammatory, regulator of T cell proliferation. T helper cell differentiation |
| NOD2 | −14.98 | PRR, inflammasome activator, promotes autophagy |
| INOS | −26.88 | Proinflammatory, generator of nitric oxide |

These data appear to show two gene expression signatures—CXCR1/2 ligands (CXCL3, CXCL2, CXCL1, IL-8), which is associated with pro-inflammatory cell migration, and CXCR3 ligands (CXCL9, CXCL10), which is more specifically indicative of IFN-γ-type responses, also supported by IL-32, which is IFN-γ-inducible.

Example 3—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Example 4—Cytokine Production in Immature Dendritic Cells Induced by MRX518 Compared to MRX518+ LPS Summary This study tested the effect of the bacterial strain MRX518 alone and in combination with lipopolysaccharide (LPS) on cytokine production in immature dendritic cells.

A monocyte population was isolated from peripheral blood mononuclear cells (PBMCs). The monocyte cells were subsequently differentiated into immature dendritic cells. The immature dendritic cells were plated out at 200,000 cells/well and incubated with MRX518 at a final concentration of $10^7$/ml, with the optional addition of LPS at a final concentration of 100 ng/ml. The negative control involved incubating the cells with RPMI media alone and positive controls incubated the cells with LPS at a final concentration of 100 ng/ml. The cytokine content of the cells was then analyzed.

Results

Figure 4A:
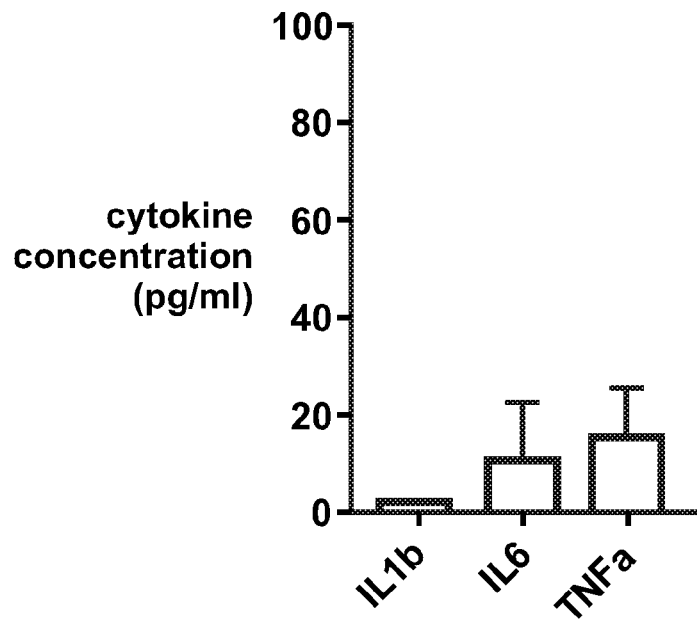
FIG. 4A: Cytokine levels (pg/ml) in immature dendritic cells (No bacteria).
Figure 4B:
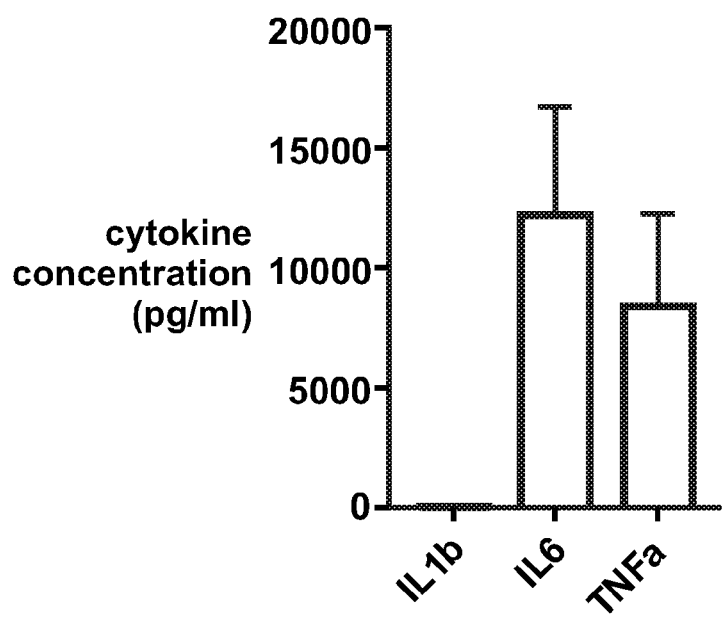
FIG. 4B: Cytokine levels (pg/ml) in immature dendritic cells after the addition of LPS.
Figure 4C:
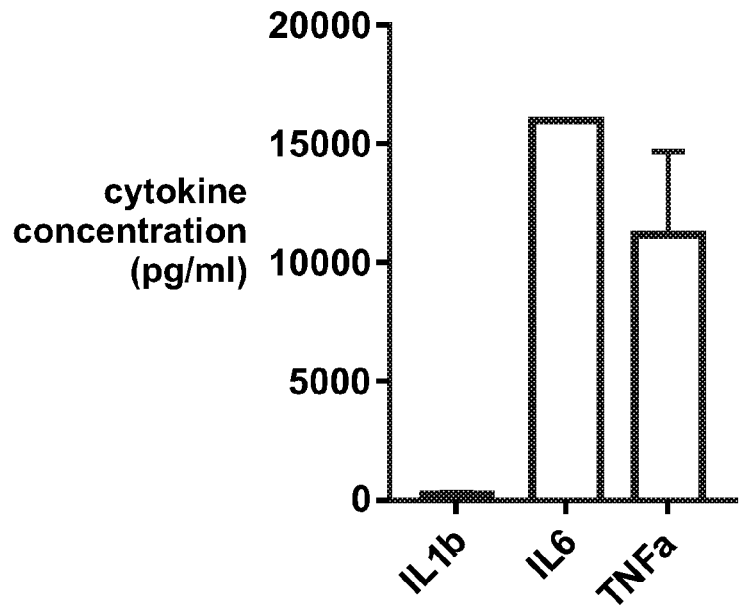
FIG. 4C: Cytokine levels (pg/ml) in immature dendritic cells after the addition of MRX518.
Figure 4D:
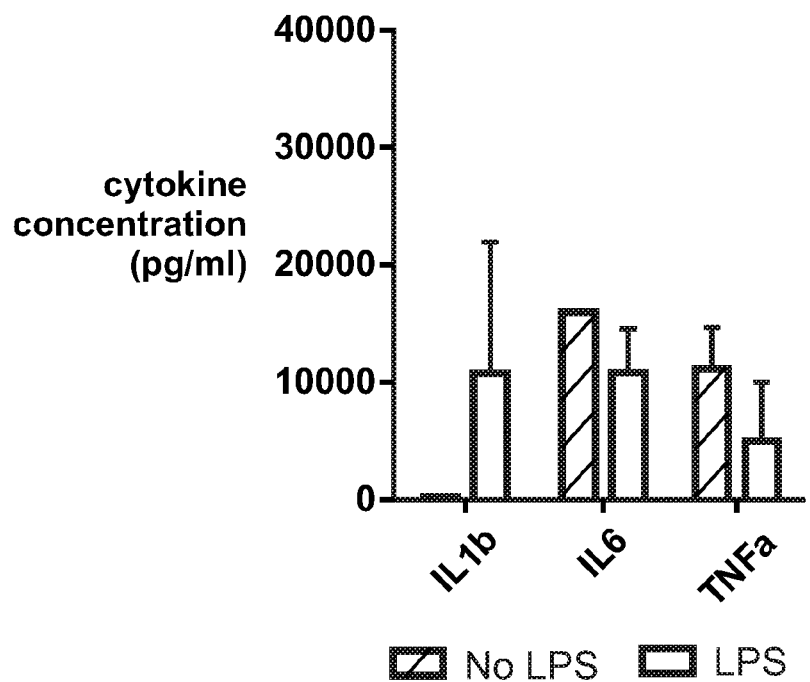
FIG. 4D: Cytokine levels (pg/ml) in immature dendritic cells after the addition of MRX518 and LPS.

The results of these experiments can be seen in FIGS. 4a-d. The addition of MRX518 alone leads to a substantial increase in the level of cytokines IL-6 and TNF-α compared to the negative control (FIGS. 4a and c). The addition of LPS (positive control) leads to an increase in the level of IL-6 and TNF-α compared to the negative control but not IL-1β (FIG. 4b). A combination of MRX518 and LPS led to a synergistic increase in the level of IL-1β produced (FIG. 4d).

Conclusion

MRX518 has the ability to induce higher IL-6 and TNF-α cytokine production in immature dendritic cells. The combination LPS and MRX518 can increase the levels of cytokines IL-1β in immature dendritic cells. These data indicate that MRX518 alone or in combination with LPS can increase inflammatory cytokines IL-1β, IL-6 and TNF-α, which promotes inflammation that can suppress cancer. Treatment with MRX518 alone or in combination with can induce cytokines that can limit tumor growth.

Example 5—Cytokine Production in THP-1 Cells Induced by MRX518 Compared to MRX518+LPS Summary This study tested the effect of bacterial strain MRX518 alone and in combination with LPS on cytokine production in THP-1 cells, a model cell line for monocytes and macrophages.

THF-1 cells were differentiated into M0 medium for 48 h with 5 ng/mL phorbol-12-myristate-13-acetate (PMA). These cells were subsequently incubated with MRX518 at a final concentration of $10^8$/ml, with or without the addition of LPS at a final concentration of 100 ng/ml. The bacteria were then washed off and the cells allowed to incubate under normal growing conditions for 24 h. The cells were then spun down and the resulting supernatant was analyzed for cytokine content.

Results

Figure 5A:
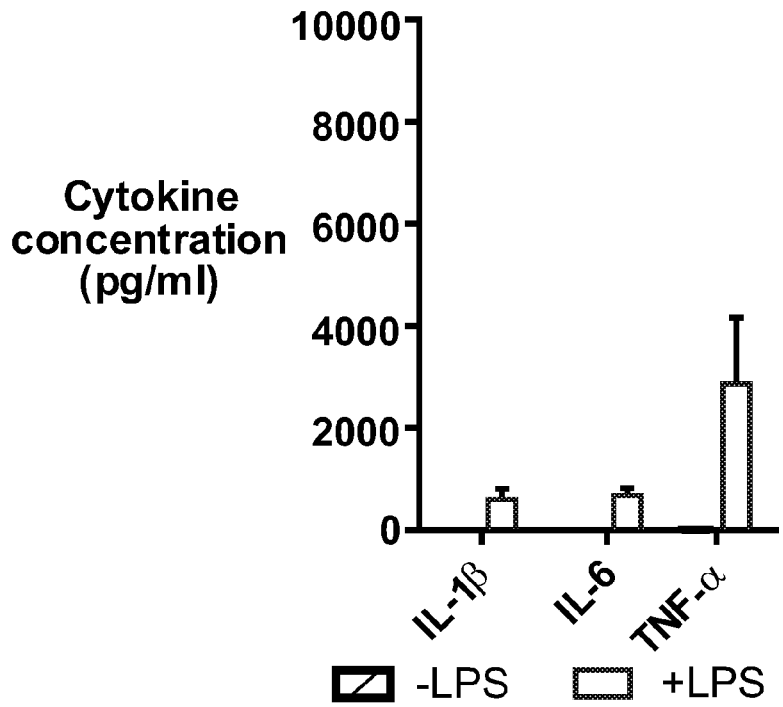
FIG. 5A: Cytokine levels in THP-1 cells (No bacteria).
Figure 5B:
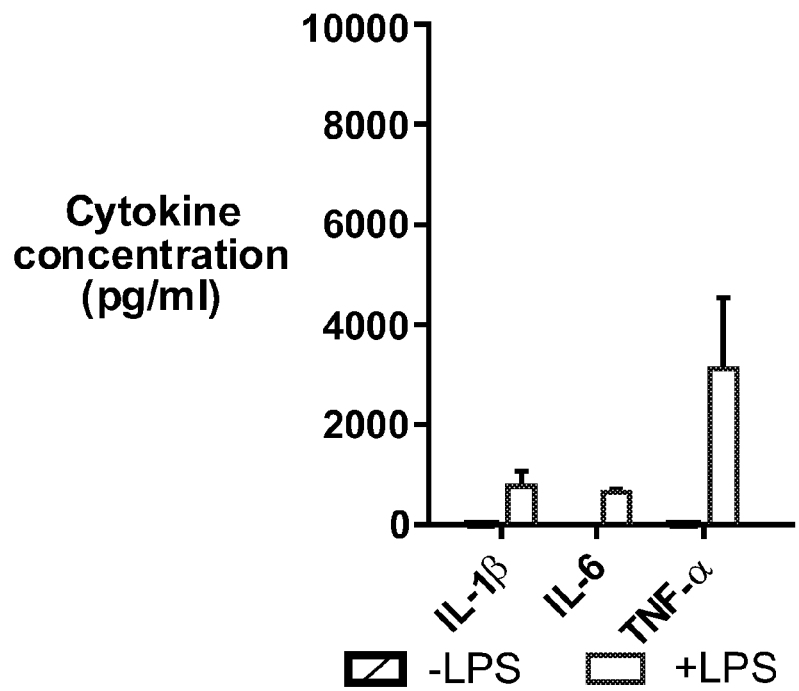
FIG. 5B: Cytokine levels in THP-1 cells after addition of bacterial sediment.
Figure 5C:
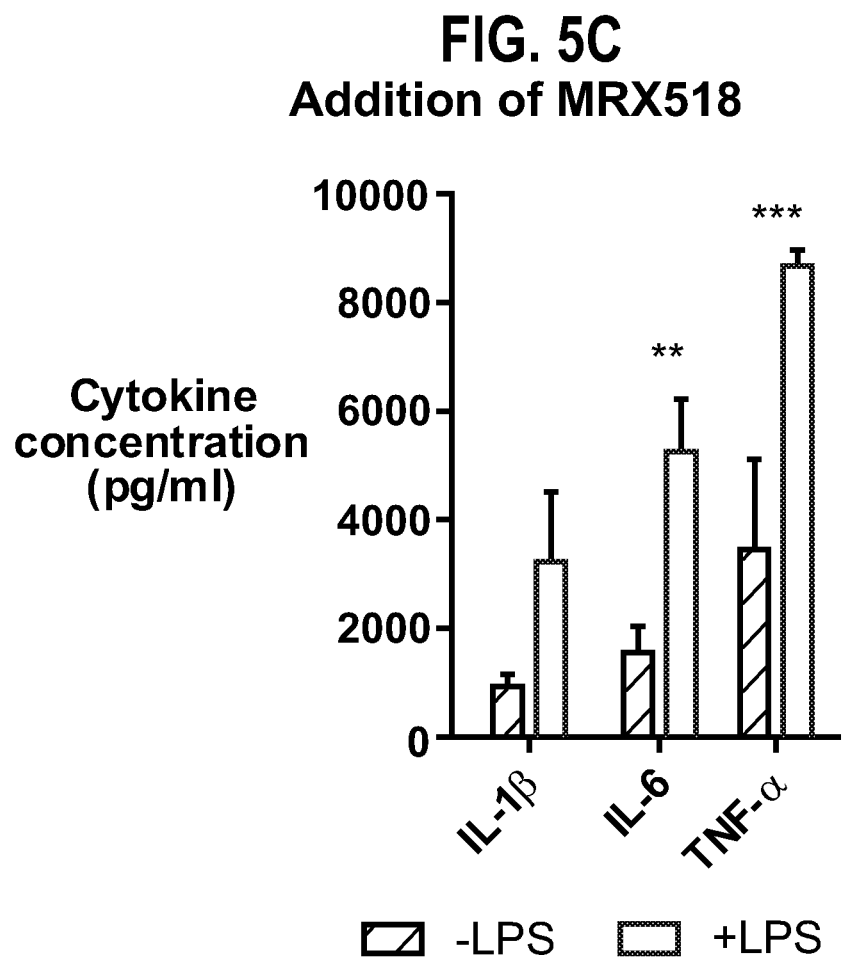
FIG. 5C: Cytokine levels in THP-1 cells after the addition of MRX518 alone or in combination with LPS.

The results of these experiments can be seen in FIGS. 5a-c. The addition of MRX518 without LPS leads to an increase in the cytokine levels of IL-1β, IL-6 and TNF-α compared to the no bacterial and the bacterial sediment controls. The addition of LPS and MRX518 leads to a synergistic increase in the production of cytokines.

Conclusion

MRX518 has the ability to induce cytokine production in THP-1 cells, which can be synergistically increased with the addition of LPS. These data indicate that MRX518 alone or in combination with LPS can increase inflammatory cytokines IL-1β, IL-6 and TNF-α, which promotes inflammation that can suppress cancer. Treatment with MRX518 alone or in combination with can induce cytokines that can limit tumor growth.

SEQUENCES

```
SEQ ID NO: 1(Enterococcus gallinarum 16S rRNA gene-AF039900)
   1  taatacatgc aagtcgaacg cttttcttt caccggagct tgctccaccg aaagaaaaag
  61  agtggcgaac gggtgagtaa cacgtgggta acctgcccat cagaagggga taacacttgg
 121  aaacaggtgc taataccgta taacactatt ttccgcatgg aagaaagttg aaaggcgctt
 181  ttgcgtcact gatggatgga cccgcggtgc attagctagt tggtgaggta acggctcacc
 241  aaggccacga tgcatagccg acctgagagg gtgatcggcc acactgggac tgagacacgg
 301  cccagactcc tacgggaggc agcagtaggg aatcttcggc aatggacgaa agtctgaccg
 361  agcaacgccg cgtgagtgaa gaaggttttc ggatcgtaaa actctgttgt tagagaagaa
 421  caaggatgag agtagaacgt tcatcccttg acggtatcta accagaaagc cacggctaac
 481  tacgtgccag cagccgcggt aatacgtagg tggcaagcgt tgtccggatt tattgggcgt
 541  aaagcgagcg caggcggttt cttaagtctg atgtgaaagc cccggctca accgggagg
 601  gtcattggaa actgggagac ttgagtgcag aagaggagag tggaattcca tgtgtagcgg
 661  tgaaatgcgt agatatatgg aggaacacca gtggcgaagg cggctctctg gtctgtaact
 721  gacgctgagg ctcgaaagcg tggggagcga acaggattag ataccctggt agtccacgcc
 781  gtaaacgatg agtgctaagt gttggagggt ttccgccctt cagtgctgca gcaaacgcat
 841  taagcactcc gcctgggga tacgaccgca aggttgaaac tcaaaggaat tgacggggc
 901  ccgcacaagc ggtggagcat gtggtttaat tcgaagcaac gcgaagaacc ttaccaggtc
 961  ttgacatcct ttgaccactc tagagataga gcttcccctt cggggcaaa gtgacaggtg
1021  gtgcatggtt gtcgtcagct cgtgtcgtga gatgttgggt taagtcccgc aacgagcgca
1081  acccttattg ttagttgcca tcatttagtt gggcactcta gcgagactgc cggtgacaaa
1141  ccggaggaag gtggggatga cgtcaaatca tcatgcccct tatgacctgg gctacacacg
1201  tgctacaatg ggaagtacaa cgagttgcga agtcgcgagg ctaagctaat ctcttaaagc
1261  ttctctcagt tcggattgta ggctgcaact cgcctacatg aagccggaat cgctagtaat
1321  cgcggatcag cacgccgcg tgaatacgtt cccgggcctt gtacacaccg cccgtcacac
1381  cacgagagtt tgtaacaccc gaagtcggtg aggtaacctt tttggagcca gccgcctaag
1441  gtgggataga tgattgggt gaagtcgtaa caaggtagcc gtatcggaag gtgcggctgg
1501  atcacc
```

SEQ ID NO: 2 (consensus 16S rRNA sequence for Enterococcus gallinarum strain MRX518)
TGCTATACATGCAGTCGAACGCTTTTTCTTTCACCGGAGCTTGCTCCACCGAAAGAA
AAAGAGTGGCGAACGGGTGAGTAACACGTGGGTAACCTGCCCATCAGAAGGGGAT
AACACTTGGAAACAGGTGCTAATACCGTATAACACTATTTTCCGCATGGAAGAAAG
TTGAAAGGCGCTTTTGCGTCACTGATGGATGGACCCGCGGTGCATTAGCTAGTTGGT
GAGGTAACGGCTCACCAAGGCCACGATGCATAGCCGACCTGAGAGGGTGATCGGCC
ACACTGGGACTGAGACACGGCCCAGACTCCTACGGGAGGCAGCAGTAGGGAATCTT
CGGCAATGGACGAAAGTCTGACCGAGCAACGCCGCGTGAGTGAAGAAGGTTTTCGG
ATCGTAAAACTCTGTTGTTAGAGAAGAACAAGGATGAGAGTAGAACGTTCATCCCT
TGACGGTATCTAACCAGAAAGCCACGGCTAACTACGTGCCAGCAGCCGCGGTAATA
CGTAGGTGGCAAGCGTTGTCCGGATTTATTGGGCGTAAAGCGAGCGCAGGCGGTTT
CTTAAGTCTGATGTGAAAGCCCCCGGCTCAACCGGGAGGGTCATTGGAAACTGGG -continued

| SEQUENCES |
|---|
| AGACTTGAGTGCAGAAGAGGAGAGTGGAATTCCATGTGTAGCGGTGAAATGCGTAG<br>ATATATGGAGGAACACCAGTGGCGAAGGCGGCTCTCTGGTCTGTAACTGACGCTGA<br>GGCTCGAAAGCGTGGGGAGCGAACAGGATTAGATACCCTGGTAGTCCACGCCGTAA<br>ACGATGAGTGCTAAGTGTTGGAGGGTTTCCGCCCTTCAGTGCTGCAGCAAACGCATT<br>AAGCACTCCGCCTGGGGAGTACGACCGCAAGGTTGAAACTCAAAGGAATTGACGGG<br>GGCCCGCACAAGCGGTGGAGCATGTGGTTTAATTCGAAGCAACGCGAAGAACCTTA<br>CCAGGTCTTGACATCCTTTGACCACTCTAGAGATAGAGCTTCCCCTTCGGGGGCAAA<br>GTGACAGGTGGTGCATGGTTGTCGTCAGCTCGTGTCGTGAGATGTTGGGTTAAGTCC<br>CGCAACGAGCGCAACCCTTATTGTTAGTTGCCATCATTTAGTTGGGCACTCTAGCGA<br>GACTGCCGGTGACAAACCGGAGGAAGGTGGGGATGACGTCAAATCATCATGCCCCT<br>TATGACCTGGGCTACACACGTGCTACAATGGGAAGTACAACGAGTTGCGAAGTCGC<br>GAGGCTAAGCTAATCTCTTAAAGCTTCTCTCAGTTCGGATTGTAGGCTGCAACTCGC<br>CTACATGAAGCCGGAATCGCTAGTAATCGCGGATCAGCACGCCGCGGTGAATACGT<br>TCCCGGGCCTTGTACACACCGCCCGTCACACCACGAGAGTTTGTAACACCCGAAGTC<br>GGTGAGGTAACCTTTTTGGAGCCAGCCGCCTAAGGTG |

SEQ ID NO: 3 (strain MRX518 chromosome sequence)-see electronic sequence listing.

SEQ ID NO: 4 (strain MRX518 plasmid sequence)-see electronic sequence listing.

REFERENCES

[1] Spor et al. (2011) *Nat Rev Microbiol.* 9(4): 279-90.
[2] Eckburg et al. (2005) *Science.* 10; 308(5728): 1635-8.
[3] Macpherson et al. (2001) *Microbes Infect.* 3(12): 1021-35
[4] Macpherson et al. (2002) *Cell Mol Life Sci.* 59(12): 2088-96.
[5] Mazmanian et al. (2005) *Cell* 15; 122(1): 107-18.
[6] Frank et al. (2007) *PNAS* 104(34): 13780-5.
[7] Scanlan et al. (2006) *J Clin Microbiol.* 44(11): 3980-8.
[8] Kang et al. (2010) *Inflamm Bowel Dis.* 16(12): 2034-42.
[9] Machiels et al. (2013) *Gut.* 63(8):1275-83.
[10] WO 2013/050792
[11] WO 03/046580
[12] WO 2013/008039
[13] WO 2014/167338
[14] Goldin and Gorbach (2008) *Clin Infect Dis.* 46 Suppl 2:S96-100.
[15] Azad et al. (2013) *BMJ.* 347:f6471.
[16] Strickertsson et al. (2014) *Genes.* 5(3): 726-738.
[17] Collins et al. (1984) *Int J Syst Evol Microbiol.* 34: 220-223.
[18] Masco et al. (2003) *Systematic and Applied Microbiology,* 26: 557-563.
[19] Srů utková et al. (2011) *J. Microbiol. Methods,* 87(1): 10-6.
[20] Haabeth et al. (2012) *OncoImmunology* 1(1): 1146-1152.
[21] Lejeune et al. (2006) *Cancer Immun.* 6:6
[22] Pace et al. (1983) *PNAS.* 80: 8782-6.
[23] Sgadari et al. (1996) *PNAS.* 93: 13791-6.
[24] Arenberg et al. (1996)*J. Exp. Med.* 184: 981-92.
[25] Sgadari et al. (1997) *Blood.* 89: 2635-43.
[26] Miyamoto-Shinohara et al. (2008)*J. Gen. Appl. Microbiol.,* 54, 9-24.
[27] *Cryopreservation and Freeze-Drying Protocols,* ed. by Day and McLellan, Humana Press.
[28] Leslie et al. (1995)*Appl. Environ. Microbiol.* 61, 3592-3597.
[29] Mitropoulou et al. (2013) *J Nutr Metab.* (2013) 716861.
[30] Kailasapathy et al. (2002) *Curr Issues Intest Microbiol.* 3(2): 39-48.
[31] *Handbook of Pharmaceutical Excipients,* 2nd Edition, (1994), Edited by A Wade and P J Weller
[32] *Remington's Pharmaceutical Sciences,* Mack Publishing Co. (A. R. Gennaro edit. 1985)
[33] US 2016/0067188
[34] *Handbook of Microbiological Media, Fourth Edition* (2010) Ronald Atlas, CRC Press.
[35] *Maintaining Cultures for Biotechnology and Industry* (1996) Jennie C. Hunter-Cevera, Academic Press
[36] Strobel (2009) *Methods Mol Biol.* 581: 247-61.
[37] Gennaro (2000) *Remington: The Science and Practice of Pharmacy.* 20th edition, ISBN: 0683306472.
[38] *Molecular Biology Techniques: An Intensive Laboratory Course,* (Ream et al., eds., 1998, Academic Press).
[39] *Methods In Enzymology* (S. Colowick and N. Kaplan, eds., Academic Press, Inc.)
[40] *Handbook of Experimental Immunology,* Vols. I-IV (D. M. Weir and C. C. Blackwell, eds, 1986, Blackwell Scientific Publications)
[41] Sambrook et al. (2001) *Molecular Cloning: A Laboratory Manual,* 3rd edition (Cold Spring Harbor Laboratory Press).
[42] *Handbook of Surface and Colloidal Chemistry* (Birdi, K. S. ed., CRC Press, 1997)
[43] Ausubel et al. (eds) (2002) *Short protocols in molecular biology,* 5th edition (Current Protocols).
[44] *PCR (Introduction to Biotechniques Series),* 2nd ed. (Newton & Graham eds., 1997, Springer Verlag)
[45] *Current Protocols in Molecular Biology* (F. M. Ausubel et al., eds., 1987) Supplement 30
[46] Smith & Waterman (1981) *Adv. Appl. Math.* 2: 482-489.
[47] Rockwell et al., (1972) *J Natl Cancer Inst.* 49: 735-49.
[48] Bertram and Janik (1980) *Cancer Lett.* 11: 63-73.
[49] Darlington (1987) *Meth Enzymol.* 151: 19-38.
[50] Principe d'éthique de l'expérimentation animale, Directive no 2010/63 CEE 22 Sep. 2010, Décrét no 2013-118 1 Feb. 2013.
[51] *Guide for the Care and Use of Laboratory Animals:* Eighth Edition. The National Academies Press; 2011
[52] Simpson-Herren and Lloyd (1970) *Cancer Chemother Rep.* 54: 143-74.
[53] Workman et al. (2010) *Br. J. Cancer.* 102: 1555-77.

SEQUENCE LISTING (4 sequences)

SEQ ID NO: 1 - DNA, 1506 bp, Enterococcus gallinarum
taatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacc

SEQ ID NO: 2 - DNA, 1444 bp, Enterococcus gallinarum strain MRX518
tgctatacatgcagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtg

SEQ ID NO: 3 - DNA, 3127431 bp, Enterococcus gallinarum strain MRX518 (residues 1-1,563,716 of 3,127,431)
tttagctcaggcagctactgcagatcaaatctaccattggatcactgttttgaatgagacgcaaaacgaggtgcgatttaccaataatccgaccatttatttggaagtagcagttgttaaactagcaaatcagaggagattgccagcttcaggagaagtttcggtgtcgaatcaagaagttcagcagcttcgtcaagaaattcagaagctgcagtcagaagtacgaaaactacaagaaaacccatcggcggccagcagtgaaccggtcaatccacctgccaagaagaccagaaatagcagcactttccgagtgccgaaagaacgggtctttcaagtcttgaaagaagccacaaaaaaagatctcgcaaatgtgcggaacatttgggatgatctgttgatgtcattgtcggtgacacaacgagcaatgctccacgcgagcgaagcaaaagcagccagtgcatctggtgtagtgattgcctttgattatgagattgtctgtcaacgagcagccaatgaccaagacttgcagctgacattgcataatcaaatttcacgaatgatatctgattatgcaccgcaagccgtgtttatcacgaaagaaagctggccaatcttacgacaagaatttattgctggcggacaaaccttcaatacaggcgaattagatgaaggggaagctgaaccagaaccaactacggaagaacctgaaaatgaagtcgtcgttaccaaagcccaagagctttttggtgaattggcgagcatcgaagaaaattgagagaattggagtgaagaacaatgatgcgaggcatgggaaatatgcaaggcatgatgaagcaagtacaaaaaatgcaaaaagagatggtaaaagaacaagaagccctaaacagtaaagaatttatcggcgagtcaacaaatggctatgtgaaggcaacttttacaggtgataaaaaattacgcgatctttcgatcgatcaagcaatcgtcgatccggaagatgttgacatgttacaagatatgctgatcttggcagtaaatgatggattaactaaaattgaaaaagaaaccgaacggactatgggtaaatacactaaaggaatccccggtttataaaaggagaaatgtggcgtgcagtatccagaaccgatcgcacgattaatcgacagctacatgaagctgccaggtatcggacaaaaaacagcaactagattggctttttatacgatcgatatgaaagatgaagtcgtcaatgagtttgctaaatcactgttgagcgtcaaacgtgatctgcatttttgcagtatttgcggaaacattacagaaggagatccctgtgagatctgcagtgacccttcacgagataaaggcacgatcttagtagtagaagaaccaaaggatgtcatggcgttagaaaaagtccgtgagtaccatgggctctatcatgttttgcatggtgttctgtctccaatggaaggtactggaccagaagatatcaatattgctcctttgattcagcgtctgcatgatgaccaagtgaaagaagtgatcattgctacgaacgccacgacagaaggtgaagctaccgcgatctatctttcccgactgatcaaaccagcggggatcaaagtgacgcggttggctcacggtttatctgtcggcagcgatattgaatatgcggacgaagtgacattgcttaaagcagtggaaggaagacgtgaattataagaaattggaggcaacaagggtgagtggactgttcataaccattgaaggaccagatggcgctggcaaaaccagtgttttagaagaactatatcctcgtttgcagctagaagccaaacgagacattgttaaaacgagagaaccaggcggtgtaaaaatcgcagaaaaaattcggcggatcatactggatcccaaaaattctgagatggatgaacggactgaagcattgctgtatgctgctgcaagacgccaacatttgatccaagtgattttaccagcattgaatgaaggcaaaatcgtgatctgtgatcgatttgtagatagttctttagcttatcaaggggcagggcgccggatcggtattcctgagattgcacgtatcaatgaatttgccaccgaaggcacggagcctgacttcactttgtatttggatgtcgattcggatacaggtttaagaaggattcaagagcatcgggctcatcagttggatcgcttggacgcggaaggattagaatttcaccaacgagttcgtcatgcttatttgaagctggcagaagaaaatcctgtacgcatccataaggttgatgctagaatgggattacaagatgtcgttgagacaagtttttcagcaatcgttgaagcatatccttcctacttcaaaacaatgtgatcgctgacgacaataataaggagatgatctcatgaaattgattatggcaatcgtgcaagacaaagacagcaaccgattagcaaatgaattcattgatgccaacattcgcgctacgaaactttcatctaccggcggattcttaaaagccggcaacagtacatttattattggtcttgaggatgagcgggtccaagacgcattggaactgatcaagaaaacctgtcagtctagaaaacaatatgtttccacaccaatgtcgttagacatctcacttgatgggcaagtaccttatccagtggaagtagaagttggcggtgcaacggtttttgttctaccagtcgatggcttccatcaatactaaaaaggagcagaccatggaggaactttttttacaagaatatcaacctctggtttttgcccaactgaagaaaagtgtcgagcatgggcggattgcccatgcttatctttttgaaggcgatgcaggaacgggcaaacatgagatgagtttgtggctggcgaaacgtctcttttgtacgaatgttcaatcagatgaaccttgcggatcttgcagtaattgtttgcggatcgctcaaggggagcacccggacgtactcatggtggaaccagatggacagacgatcaaagtagatcaaattcgtcaattgcaagaagaattttctaagagcggcttcgaaagtcgcttgaaaatctttcttctttctcaatcagaaaaaatgaatacaagtgcagcaaatagtttactgaaatttttggaagaacctgtagggaatttcttagcgattttagaaacggaaagtgttggacggatcttgccgacgatccagtcccgttgtcaaatcattcatttttcaccattggcgaaagaaaaattgcagacaaagctgcaaaaagaaggactttctcaagagagtagccgtcttttgagttacttgacaaatagttatcataaagcagttgaaatctcccaagaggaatggtttaatgaaactaaggatgctgttgcacaatgggtgaagtatctcttgaagaaagatccgcaagcgtttattttcgttcaaaaaaagctgctcgctttagcaaaagaaaaagaacagcagagagttattttttcgattctgttattttattttcaggaagaacgagaccagttattggcacaaggcttatggggaaaagagatcaatcttgccatcgaagctgccttgcaagcccaaaagaaactgcaagcgaatgtagcttttcaaggcgttgctgaacaattttcagtgaagatcatctatgacataacagtaccctaaagggggagcaatgttatgatagaagtagtcggtgtacgctttcgcgctgcgggacaaatctatttttatgcgcctgagaagcgagattacacgtcgggggaacgagtgatcgttgaatcacaagaagcaaagtttatggcgaccgtcgcgattcctaagcagttgatcgattcgcaagatttgccttatgacataaagccaatcattagacaggccacgcctaaagatatcgagaaagaaaagaaaaatcgtcaagatgctgaagaagcgctgatcattggcaagcagaagattcgagcgcacaatttacctatgaaacttgttagggcagaatatacatttgagcggtcaaagatgctgtattattttacagcggatggtcgagttgatttccgcgaactagtcaaagatttggcgagtcattttcatacaaggatcgagttgcgacaaatcggtatacgagatgaagcaaaggcgatcggcggaattggtccatgcggccgcaagctctgctgttcgacgttcttaggcgattttatccctgtctcgatcaaaatggccaaagatcaagggctgtctttgaatccgacgaaaatttccgggttgtgtggtcgtttgatgtgctgtttgaagtatgagaatgatgaatatgaacaagcaaaacgagaattaccggatcgcggcaaagaagttgagactccggatggaaaaggaaaagtagtcggtctggatttattgcagcgcattatcaaagtccgtttgtacgatcgacaaacgcccatagactatgaatatgaagaactagtgacaaaataagtaggtgaccataatgagcatggacaagcgatcgatttatgatggattgaatcagttagaaaatgaactgcaaaattcgttgaataacttagcagagatgaaacagtctttgcaagaaatcgttgaaaaaaatacgacgctagaattagaaaatcaacgtttacgggaacatatccgtgaattgaatcaagtggccgaagcgcccgcagaatcggtcaaacaagaattgtccaaatcgcgaatgaatttggaaaagatatacgaagaaggattccatgtttgttatgacttatatggatctagaagagaacatgatgaaccgtgtgctttttgtcttgaagtgatctatcgagaaagcggacgataataggaaatgaccagcgcaggtggctggtctttttttgaaagtagggaaagtatgcagaaacaacaaagctataaacaatcgaatggaacgctttatttagtgccgacaccaatcggaaatttggaagacatgaccgttcgttgtgtcaaaattttaggggaatccgatttgattgccagcgaagatactaggaatacccagaaattattgaaccattttgaaataacgacaccgcaacgaagtttgcatgaacacaatttcaaggaacgtgtgccgcaactcatcgatcaattgctagctggaaaaataattgcacaatgtagtgacgcagggatgccatcgatcagtgatcctggtcatgaattagtcaaagcgtgcattgcagctgatattccagtgattgccttgcctggtcctacagcaggattgactgctttgatcgcttctggtttgtctccgcagcccaatcttttttatggcttcttacctcgaaaaaagaaggagcaaaaagaagcattggctgagctggcgaaccagccggctacgatgatcttttatgaatcaccttaccgcttggcagcgacgatcgaaaatatgattactgtttttggtgcagaacgttctgcagtcatctgtcgagagttgtcaaaaatccacgaggaatacttgcgaggttctttaaaggaactgttggactatctaggggaaaatacagtcaaaggagagtgctgccttttggttgagggatcgacggactctgtcgaaatcgtttatgatggaagccttaaagagcaagtaacagctctgatggagaccgggatgtcttctaaggaggctatcaaggaagtggcgaaacgcaatcaagtaaaaaaacaaacggtctatcatgcctatcacttagacgcttaaccgatgcctgtgcatcggtttttttgaataatgagtttcatttttagtggcatggatgattgggtgaaaccgtcacaaaaggacatgatatactagtttaaaaaggagaaaaagatgaacatacgagacatgcaaaaagcgatctatcaaaacaaaattgatcatcaatttaatgtcaccaatattgaaaaggaatttttgtcattatatggtgaagtggctgaagcttttgatgcttatcgcaaaaaacaaaatgtgggggaagaattggcagatgtagccatctaccttctcggtttagcggagatcttatcgattgatctagacggagagattcagaaaaaaatgaaaatcaaccaagcccaccgctataccagttatggcaatgggtatgcaaaacgaatcgatgaatgatggttcgtcattcgattgaactgacaatgaattgttaaaggaagtgggaaacgaaatgacaaccaacttaagcatacgtgagctaacagaaaaagatttaaaggaagctgttgaaatgtatattgcagtcttttcagcggagccatggaatgatcaactgaccgttcctcaaattacagaatatgtgtcatccatgatggcgatgaatacttatattggctattttctaacggactcattgaccaatgaaaagatagggtactcgttaggctttattaagccgtggtaccaaggaaaagaatatgtcatcgatacctttttaattgctggcaagcatcaagggaaaggtttcggctctgcttttttagaaaggatcaaagaagagttggtcaaaaaaggcattcccacgatactattagatacagaagaaaagatgccagctgccgatttttataaaaagaatggctttaagcctttgacggataatgtgactttttatgcgtcgttttgatcgccattacccaagaaagccatcagtcgaattgcgaatgttagatttcataacatataaagtgagcttttttcagaataattgcaaaaatttaaaaaaacactagcgatctcctggataagatggtaggatatctaacataaaagggagtgattggaatgggaacaggaaatagtgggtttattttggtttgcagtgggatggtttttttaatgactcctgcgctagcttttttttatggtggattggaaaggcgaaaaaatatcttgaatacaatgatgatggtgatttgcaccatgggactagcttcagttctgtgggtggcggctgggtattcgctttctttcagtggtaccggtgcgtttatcggcaacatcgataagttatttttccagcaagtttccatgacggacggagaagggattcctgaaggattgtttgcggcttttcaaatgatgtttgcactaatcacaacagcgatcattaccggatcagtcgtaggacgaatgcgtttttcagctattttcttatttattggctgctggctgtttttggtttactttccgatggcccatatggtttggggtggcggcttcttagatgctatcggttcgattgattttgcaggaggcaacgttgtccatattagttcaggaatcagcggtctcgtgctagcattagtcgtgggtaagagacgcgagtttcatcaaacggagtatcgtccccataatattccatttgtcgtactaggtgcagggttgctatggtttggctggtttggcttcaatgctggatcagcattagctgctgacgggatcgccattcaagcgttgttaacgaccaatacggcagccgcagctgcgatgctctcctggatgttgattgaaaaagttctattagggaagccaaccattgtcggagcttgtaccggagctgtcgtgggtctggtagcaattactcctggcgcaggttttgtttccctttggtcatcctttgtgatcggggcattagtgagtccgttttgttattactttatttcggtcatcaagcatcgcttaggtctggatgacgctttggatgcttttggttgtcatgggattggcggaatctttggtggaatcatgacggggattttcgctgatcctgctgtcaatcatcaaactgggttgctctatggtggaacagaattgttcattgcgcagatcattagtatcgtatttacgattctttttgcggggggcatatcttttctattgatccatgtgatcaaacgcgtgctaccgatccgggtcacagaacaagaagaagctattggaatggatcgcagtgaacatgatgaaacagcttatccaacgttcatggggctggattcatagatggaggaatgcagatgaaaaaagtagaagcgatcattcgacaagaaaaattagaagaattaaaggcagctcttgatcaaatagatatggctggaatgacggtgagtcaagtattgggctgtggtaatcaaaaaggggtcaaagaatttgttcggggacaagcagtgattacgacacttttgcctaaagtaaaggcgagttttgttgtagaagatgaagaggttgaagcaatcattgaactgattttgtctatctgccatacaggtgaagtaggtgatggtaaaatttttatttacccaatcgaagaagcagtacgaatccgaaccaatgaacgaggcccatcggcgctgtaagtctagacgtttttaacgaatcgaaccaaatttgaagtcttaaatcataacgggaagcaaaaagaatttctgtcttttttacagggattctttttgtttgcaacaatcgccgatgcttagaatgagcctcttgatagggaacttctgttcgtttataatagaggagaatggagtggtgaagatggctgagttgcgttttccgttaaaaaacgatacgtctcggaaaatcatccatatcgatatggatgccttttttgcatcagtagaagaaagagacaatcctgaattggctaagcatcccttagtgattgcccgccacccaagtgatactgggggtagaggtgtcgtcacgactgccaattataaagcacgtcagtatgggatccattctgcaatgagtgcgcaaaaagcctttgaattgtgtcctcatgccgtctttatacctggcaaccatcagaaataccgcgaaatttctcagcaagtccgagagatctttgggcgctataccgatgtgattgaaccggtttctatcgatgaggcttatctggatgtgaccgtcaacaagatcaactgtccttcagcgatcaaaattgctcgcatgatccagcaagacatttggcagacgacccagcttacttgttcagcaggcgtcagctacaataagtttttagccaaattatcttcggattttcacaaaccccgggggttgacggtagtgatgccggaagatgccgtggtctttttaaaaaaattaccgattgacaaatttcatggtatcggtaagaagacagtgccgagaatgcacgaattagggatttataaaggatctgacctttatgaatggagcgaaatggcattgatccaagaatttggaaaaatgggctactcgttataccggaaagttcgaggaatccatgattctccggtcagtgtgacgagagaacgcaaatcagtcggaaaagaacatacgtatggcaatgcgttaaccacagaagatcaagtcatcagtcagctaagaaacctggcagaagaagtagaaagatcattgaaacgtacgcaaaaacacggaaagactgtggtgttgaaagtgcgttatgccgattactccaccatcacaaaacgggtcacgttgccagagtatatgcacaagaaagaagctattttttcacaagctagtttgatttgggaggagattctaggaatcgaaaaagggatccgcttattggggatcacagttacgaatcttgatccattagcttatgaaaatatcgtattgcctttgtgggaaacagaataaaatatatggaggcgcataatgacgacaaacagtcaatggaaagcgttactagaggaattcatggcacaagaaaatccagcacgaaaagttcaaatgcgggcgtacatgcggaaccaatttgactttttagggattccgtcacctgtacgcaaacaaatacaaagaccttattttgctgcaatgaaaaaggccgccatcgattgggcatttgttgaaacctgttggcaactaccttatcgtgaaatgcaatatgtagctatcgactatctggtaacgatgcagtcggtcctccaaccagacgaactggagaaaataagtgaattagtccttcaaaagtcttggtgggatactgttgatggcttgaataaagttgttggtgggctgactatgacctacccggagttgagccaaaagatgcttgcttggagcaaagcagaaaatttatggctccggcgcatcgccattgaccaccaactgcttagaaaagaaaaaaccgatcgcgagcttttagagacgatccttttaaataatttaggtagcgatgaattctttatcaataaagcgattggctggagtttgcgcgattatgctaaaacaaaccctgagtgggtgcaggcttttctgttaacgcacaaagatcagttagctccgttaagtatgaaagaagcaagcaaacatttgtaatgatggtgtgttttatgatcaaaataaaagggaatgtgccataaatctcctacaagtaacactatccgaacattaattattattgctcctgcggtgcagggactcctcgtcgcaaaagtcagaggaatctatcctagcaacagactattattcggtttaacttgttggatgatgacttatgtcacagtcccttttatcttttgtatcagtttgaaaactgaagtttattcaagtcgtcaaatactctttttgatttgttcatagcttttttctgcgtctttgcatttgtcccaaatcaccgcttcgcctagtgctagggatttaggaacatcaatgattcgttgattgctgctaccgcgaaattgcagattcaaattgcgtttgctcaattcgaaacggccatcaactaggatatcgatgcgagacagcaactcaagcttatcttctgtttccaacagtagttcctcgaaggtgtaaccagaccagctccaaatatctttgccatgaccgaactcggaacggactctgtttaccacttgcagacatacttcagtattcaaaaaaggttcgccgcccaatagtgttagtccctgaacataatcgtgccgcaaatcttcaatgatctgttcttcgagttctgctgtgaatggggtgccatagcggaaattttggactgctttattgaaacagccttcgcaagcaaataaacaaccactgacatacaggctattgcggataccttcgccgtcaacaaagttgaaggctttataatctgcaatatgattttgactatactcttttgcttgccattctttggggcgaggatttctcatgtgcaaaacttctttctaactattcgattattcgataaaaatgtccttcgcgactgtagcaaaaaccattagaaagcacaaatgcgcgagcaattccagcactcgttttctgcggactcctgaccaacagttgtcagttagaaagaagcagaatttgcttacgctttagtcgcgtaggggacacttgtttcagtcattatgtttcatatgtttgacacgagcggaaatttctttgtgacgaccgtgaaccattggtcgagcttgaggatttcctaggtaaccgcatgttcgtttgacgacgtcacaactctttggatcgtgattgccacattgtggacattcgaagccgcgttcagttggattgaaatcaccttcatatccgcattcataacaatgatcgatcggagtgttggttcctagataagcgacacgatcatacgcataattccaaactgcttcaagagctttgggattttgttgcagaactgggtattcacaataatgaataaagccgccagaacaatactttggatagtctttttcaaaatccaacttttcaaatggcgttggatttttgcggacatcatagtggaagctatttgtgtaatattctttatctgtgatgtcttcaacgatgccgaatttttctgtatctaaacgacaaaagcgatcggtcaagctttcgcttggtgtggaatagacgctaaaatgatagccgtattcatcgccccaagcatctgcatgggcttttaactctttcacgatggctaacgtgaattcttttgcttcaggatcattttcccactcaccaccaaagaaagcagcagctgcttcatacaatccaatataccctaaggaaacagtagcacgtttatttttgaacaactcgttgacactgtctttgcgatcgaggcgtttgccgaatgcgccatacatgtataggattggtgcatttgccggactcgcttctttgcaacgttctactcggtaaacaagcgcatctttgacgatttgcagacgctgctccagaagagaccagaatttgtcgcgatctccgttagcttctagggcaatgcggggaatattcaatgttacgactccaaggttcatccgtcctacattgacttcttcgccatgttcatctttccagccttgcaagaaagaacggcagcccatcggtactttgaaactacccgtcaattcaatcaacttgtcataattcaagacatctggatacatccgtttcgttgcacattccagagccaattctttgatgtcgtagtttggatctgtgggttccagatttacgccgcgtttgatactgaaaatcaacttcggaaagattgctgtccgtttttcgctgccaagtccgttgatccggatctgtaagattgcacgttggatttctcgctcaaaccagtttgttcccagaccaaagcctaaggaagtgaaaggtgtctgtccatttgaagtaaacaaagtattgatctcatattccaaactttgcatcgcatcgtaaatgtctttttttgtcttgttcttcgcgtaagcttcttggcgatcctcgccgtcgatccattcacgcgcatcttgcaagtgtttttgatagttcaattcagcaaaaggtgcaagtaattcatccgtccggtctgcagaacaaccgccatattgactagatgccacattggcaatgatttgagagatctgagctgtcgccgtttgaatcgattttggtgattcgacttctgcgtttccgattttgaaaccattgttcagcatgcctttgaaatcgattagacagcagttagtcatcggagtataaggatgataatctaaatcatgataatggatatcacctttttgatgggcgttcgccacatgagggggcagcattttcaagccgatggatttccctacgatccctgcagtcaagtctctttgagtattgaagacattgctgtctttattggcattttcgttgaccactgcttgatctttattcattaatttattgatcgtaaagttgatatccgtcgctttgctgcgttcaaaatcgcgacgtgtccgatagttgatatactcttcggccaatgcatattcattttttgctaataaaatatgctcaacgatgttttggatttcataaattttaacgtttttggtaaaccgttcggcgatctcatgatcgattccttctacgatttctaaaatccgttcatgatcgaggggagatagttctcctttaacttttctttgggcttttactaatgcatcgtaaattttttggtcatcgaaatctactaagcgaccatcacgtttcacgatctttaattgggttaattgaggatggctacccccgctttgttcagtatttctctttaagtccatcattactatcactccttatcttctccaatatcataaaacaaaatatggttttcggcaactatatatagtggcttttattcgctaaataattcagtatgcacaatatgtagtgtatattcaaaagcggttttcaataaaaacttgatgataacaaggacttgcatgtttcacgtttcacaaaatgaataaaaattgtaaaaaatttttatgtgtaaaaacgaagcaggggcgatagagaagaaaatatgctaccataaagaaaatatgaagaaaagtagaaatagatcaaggagaatttgcatgaaaaaaatgatcgatgtgaagcacctgacaaaaacctatggaacccgcttcaatcaaaccaaagtcctggacaatctttctttttccgttgatcaaggggaatttgtggggatcatgggaccaagtggtgccggaaagacgacactgatgaatatcctctcctccatcttacgtccgagtctaggttctgttgcaatcggaggacaagaaatcacccgcttgtcagaaaatgagctaagcgattttcgccgaaaagaaatcggctttatttttcaagattttaatttactagacacgttgactgccaaagacaacattatcttaccactggcgatcgaccgtctttcggtcaatgaagttgaccggcgattggcacatctggcgaacttattgggaatcgctcatttgttagaccgctacccagaagaactgtcggtcggtcaaaagcaacgggtggccgccgccagagcaatcatcagccgtccttccgtgttgtttgcagatgaacccacgggatccttagactcaaaagcggcgacagagctgttgcgttatttagctgaaatcaatctgcaagaagatatgacgattctcatggtgacccacgatcctttcactgcaagttattgcaatcggattttgtttattagagatggtgtcttttttgcagaggtagtcaaaaaagggtcccgcaaagaatttttcgaaaaaatcatcgatatgcaagcgacgattggaggcggggatcgccatgctctataaaattggctggcgcagttttttgcagcagtttcgcaattatgtcgtttactttgtgtgcatgatgacggcagtcatgattttttattcatttagtgctatgatgaatgaccgtttgctgactcaacgagtgcagcaagacattcgcatcgatggcgtattaggttttggtagtacgatcgttgctgttgtggtgcttttttttatgctaagtgccaatcatttcttcttgaatcaacggcaaaaagagatcagtgtttatcagctcctgggtttgcgcagagcaaggttaagctggctactgctgagagaaacgttcctcctaaatcttttttcccttgttgtgggcattttcatggggattatattctcgaaatttttctcaatgatcttgattcgagtgatgggactatccatcactagtcatttttttaattcgcctcgttcgattttgactaccgtgttggtattttcgcttgccatggtagttttgagtggtcaagtggttttgtttgtctggcagaatcctttgatcgatctaatgaagaacaactatacactgccagtgagcaaaatgaagtgtcgcccatttcggatggcaatggggatcatcggtttgcttctgttagggatcggctattacttagctctgacgctacgaacgacactggagcgctatattaattatacagaagattatactgctgttttatggattccattgctgattttattttgctgtatcacagcgacgtatttgttctttgactgcacattgccaatgttgttgcatgtcttaacgctcccccgcaaaaaaatcagcaaaggcacacgcttgattgcattcaacaatatccgggcttatttgcagcggacatggaaaagtttttcattactgacgatcattactgcgatcgcgatttctttgattggtggcacgatgggggtgatttccttgaattatcaggcgaccaatcgtgattatcccgtcgattttcaagtcgcagcagaaaatgcggaagagttaaagcaagtgattctggaaaatcagagtcaggtcgtcgcggagcagacgctcacttttcgtatcgtgccgttaaacatcaacgcgaaatacttggccaatccgataaatacaggacaagaaaccgtattggtcaatgcgctttctttatccgattaccgagcatttcgtcgattggtgccggatgcacctgcggtttctttaggagaaaatactgctgttttgtttgatgatgattatgatattgcatacaacttgagaacttaccaaaaaaatattgcgctggaaaatggtaaaaaactcctcttagacaacacgtatcaagattattttggtgatattgcgttgcgttacaccttacccaatgtattagtcgtcaatgacaaggattttcaggacatgtcgggatttgactatcgattgacttatttcaatgttcaaacggagaatcaagagcaattaactcggacgttagatgatcgactttcagtcgaatggacctatccgttttattacaagcgaacacaggacaaaggccaagtcaagtatcagctgcaaacggagatctcagagaagcaacaatcatcgaaggagtttattactggttatcgcttgaacttcgccaatcgctatccgaatatgcgggccattagacggcaaggcggtattattttgttcgtttctttatttgtcggggtgatcgttttgatcactacgtctagcagtttgattgtacggcaattttctaatacagagcgggaaaaaagaaattatcgtttattgcgtacactcggttatagcaaaaaagaaattcgttcgatcgtctactggcagaatttttgggttttcatgccaggtacattactcgcgattttacatgccgcattcgcaatcaacacgctgacgcaaatcatcgtgagtccagggtattgggtggcacatctgtttgcaggtgttgcagccgtcgtattctttattgcttatttgattacagttaagttatgcttacggatcattgaagagtaagctgtcagatttttttcaattttgagctggtacaagacacgaggaatggtataatttaagggataaatgagtagaggagtagataggatggataaaaaagaagagcaattactgattgatctgacaactgcccgtggtgttccggggaatgaagaagaagtacgggaagtcttcaaagcatatgcgaaagactttgccgaagatatcttttacgatgggttaggaagcgtgattgccaaacatgtaggggatggcggcggacctaaagtttttatttccggacatatggatgaagttggctttatggtgacaaagatcaccgataaaggtttcatcgagtttcaaacattaggcggctggtggggccaagtgatgctggcacaagaagtagaaatcaaaacgcaagctggcaaattggttcatggtgtaatcggttctaaaccacctcatgtgttgacgccggaagttcgcaacaagccttatgatatcaaagacatgttcattgatatcggtgcttctagtgaggaagaagcaaaagattggggcgtacgtcctggagatatgattacgccgtatatccaatacaaacggatgaatgacagtaagtttttgctagctaaagcgtgggataatcgtattggaacagcagtttctttgcgtgtgttggaaacgttggctgctgaagggcatccaaattgcttgtttgctggcagtgatgtcatggaagaagtaggattgcgtggcgcacgaacaagtacgcacctagtgaatccagacatcgcgattgctcttgatacggggacagctggtgatacgccaggaatgactccaaaagaagcagattctgtcttgggcaaggggccgcaagttttgatttttgatgcatcgatgatccctcataagaaactcttgaattttgtgatcaatgttgcggaagaattagagattcctttccaatatacggtgatcaccggtgggggaacagatgccggtcaaatgcatctgacccgtgatggtgtaccatcgatcgcgattacagttccagtgcgctacttgcattcccatacttctgtcattcatgaagatgactacttaaatacagtaaaattagtaacagaagttgttcgtcgcttagatgacaaaaccgtgaaagaattacgaagctattagaaggagtagaggatgagaaaaaatagtgagatccgctccatggcatcacgtgcattaaagggcatgtgggggcggtatattttagcctttattgctacgatagccattcaaagcatggttagcagtttggtgctgtcattgacaaaccatacctttcaacagacacgagaaacaatcattgattatattttggaatactttgtttttttcgcattgacgataagtttaaatatcatggcactgttcttgattcgtcagcgggagatccatgtgtcggatatttttcttgtttatgacaagcgttattacgtaccttttctattgctgaatttggtgaatgctctcgtaaattatctgattagttttgtgacgtttttaccccatttagttgttggcggaatgaatcagtaccttgatttagtcttgaatgtcaacagtcggatcactgtagactggagtctcttccgttcgtcgatttccttcatcatcagttttcttatttctgtggtccttttcttatttgtctcccagatcataagcggattatttcagtttgcgatctatgtacgatacgaccatccagaaatgacgacgctacaagcgataaaaggagcttggcatttaatgaagaatcatatcggtcagtatattttgctgcagatttctttattaggatggatggttttaggtttgtttgcttttgttatcggtctattttgggcgctggcctacgcaaacactgcgaatgccgccttttatcaagcgttgatcgaaaaagaaaatgatcgcgttcttagctaaagaacacctcttgtaaagatatgatccacggttgtgacgttgggtgactcaatgcagcaatgagagagaaaatcatcgatttcttttggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctgggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagcctttcttttgctaatgagctccagctgtcgcagccgtttttgctgtttatttttgagtaatccaatgcttttgtgatagcatagggataaggaggcggaagtatgaaactaacagttttaggatgtttaggcgcatatccctataagggtgagggaactactggctatttattagagtctgagggatatcatttgttgctggatgctggcagcacgacactgattcaattggaaaaaatcttggatccgttagcattggatgctgtgattttgagtcattaccatcacgatcatatcgcagatctgggtgtcttacagtattattggcagctatttcctaagcaagcagagcggaacgtattgcccatttatgggcatggagaagacagtattcatttcaatgagttgaccatggcgggagttacagaagggcatgattatttacaaacaaaacagttggaattgggaccgttttctgttacatttatgaagacgattcatcctgtaacttgttatgccatgcgctttgtggagaatagtacaggtaaaatatttgtattcacaggcgattccggctacttagaaagttttgtcgattttgccaaagatgccgacttatttttagcagatacctacctctttgcagggaatgagcgccacaaagctcattttacttctcaagagtctggagaaattgctgccgcagcgaaggtcaaaaaactggttttgactcatctcccacagcatggtgatctggagcaactgaaagaagaggcagcagcggcggccaacgggataccggttgaattggcagcagttcaaaaaatctttgagatttaaacccgaggaggagtagcagatgctttttgtaccaaatgaaaacaacgacccaagaatcaacctagccattgagatctttttgctgcaggaaatgaaggtggatgaaccgatcctgctgttttatatcaatgagccgtcgattattattggacgaaatcaaaatacgatcgaagaaatcaataaagactatgtcgatgctcatggaatccatgtggttcgccgttttagtggcggtggggctgtctatcatgattttggaaacttgaattttagctttatcatgccggatgacggtaattcattccgtgatttcgaaaaattgacgaaaccaattgttcaggcgcttcatgaaatgggcgtcgaaggggcacaattaaaaggccgcaacgacctagtcattgatgatatgaagttctctgggaatgcaatgtacgccaccaatggtcgaatgtttgctcatgggaccatcatgtttgacagtgacattaatgaagtggtcaatgcgttgaaagtgcgcaaagataaaatcgaatcaaaagggatcaaatcgattcgttctcgcgtgacgaatatcaaacctttcttaccaaaagacaaacaagatatgacgaccgaagcgtttcgtgaagagattcttttgaagatttttggtgtggattcagtcgaccaagtcaagacctatacattgactgaggaagattgggtcaaaatcaacgaaatttccgacaagtattatcgaaactgggattggaattacgggaaatctcctgcgtttgatattgaacgccgcaaacgatttccaattggatcgatcgaagttcgctttaacgttcaagaaggcaagattacagaagcaaagatttatggagatttctttggattaggagatattgctgacgttgaacaagcttttatcggcacccgctatgataaatctgcattgaaagatgtgattgatcaaattgatgtcaaaaaatattttggcaatattacccctgaggatttgttggaattagtttattgattttccagcaaatcaaaaaaagatgtggatataacgaaaatctatagaataactgaaatgcactaagaaaaagcagccacagatcctacgatctgtggctgctttttcttttagtgaacatgccgtttttttacgggttgcgcttttttctttttgctctttgcttagtaagctcgggcaatccaaacggtgtgtttagcaggtttcccgctgacgatgtcaactgttttttccataggagcttcaaatgggatatttctggtagtaaagccagtttcttctttgatcttggcttcagtttcttctgtcccgtcccaaccaattaagacaaaaccagtgactttatcttcttttttgcaggtttcgatatgtgcttttaactcttccagtgtttcgatatcgtaatactcgttctctttatttctgttacgagctgcttcaagcaaacgtggtgtcatcgcagccaattgctgatccacgaaatcagcaaggtcatcaaatgctacggtttgtttttcggcaagatcacggactttgaccattacatgcccattttctaaatctcttggaccacattcgattcgtaagcaagcgccctttaattcccactcgttaaatttgtaacctggcgaattgtcagaatcatctaagcgaacacgaatacctttggctttgaaagatgcaaacaactcttccaatttttctaaaatggcaggatttttcttccaaggtccgactggcatcaagacgatttgcgtaggggcgatcgttggtgggaaaaccaatccgttttcatcaccgtgagtcatgatcaatgcgcctaacaaacgtgtagaaacaccccaagaagttgtatgtgcataggtatgtttgttttctttcgataaataagtaatatcgaaagcttccgcaaatttcgtccccatataatggctcgtaccggcttggacagcttttccatctttcatcatggcttcgatggagtaggtatccaccgcgccagcaaaacgttcagaaggtgttttttgtcctttgtacactggaatggctaaaaattcttcgcaaagacgtgcatattcatccaaaattcctaacgtccgctttcttgcacctgcttcatcttcatgggcggtatgtccttcttgccataagaattcagaagtgcggagaaaaggcagtgttttcttttcccaacgaaaaacattggcccattgattgatttcatatggtagatcacggtaagaattgatccaatcagaaaaggctgaaccgatcatagtttcagaagtaggacgcaatgctaatggttcttctaatttttcattaccgacttctgtcacccaaggcaattcaggagcaaatccttcaatgtgatccgcttctttcgtgaaaaaactttgggggatcagcattgggaaatacgcattgcgaatgccttctgcttttaaaaagcgattaaattcttcttgaatatgttcccatagctcaaagccatcaggacggaagatgattgatcctttaactggcgaataagccatcaattcggctttttgaatggtctgaatgtaccattctgtaaaatcatttttttgtgtcattgtttttcctccttaaaaaataaaaaagcattccgtcctataaaaaggacgaaatgcttggatttcgcggtaccacctttgttgactattgctagtccaactcatgaaggataaggtcttcacaccgaccgttttgcggtcactaccattggcaggttcttcttattagcgggtattggatttccagcttgctccaactctctttaaccatcataagaatactgatccaaatcttacattcatgctaaatcgaaactcggaaaaaagcaagctttttttgtcattttgttattcattactgactagctctaggtaatctggcaacccatctgaagaaaatgtcagagaaaaacgagtggcttgttcctcatgtaagaccgagcaagacccaaaattttgctgggtcagtttttcaataatctgaagatcaaaatagttttcttcttcaaaggtttcaatattcggcatggcttctttttccgaagtagccaaagttggaaactgacagctgacgaacaattgattctgctgtttgatagcacttagatgaatcttccgcagggcgcgatctttgagtagatacgtttcccgaattgcatagtccattaaatgagcaaataattgtagaaaatcttcttcagctagttctttgattgcgggaatatccacatcataagagaattcaatgcttttttgctgagtcaattgctgataacttgtcaatagcagggttgttagagaatgatcttcacttttgattggacaggattcttctagcgtctgctcgattaggttgatttgatcaaaagctcccagcaaactgttgtcttccagcatgacttttgcagtattcaactgtttgcgaaaaccgagaaaagcttgttgccattgattgatttgttgttgaattatcggttgttgttcttcatacaagcgaatcttgagtcctgcgatatcctgtttttttgttttcccctcattatagaaaaacaaacgcagcaaatcatagcaccagcagacaataatcaagagtacgaagaaaatcgtattccaattgatttttgattgatcgctgtttaggacatcttgaatgtagataaagcagtgaccaatcgcgaataaaacgatccagggagaacaaagaacaaaaaattgattctttttaaccgcttcatagatggcagcaaaggatgtcacaagagtgctaaaaatattcagtaaatggatataatccataatttccggcaagtggagttgatgggaaaagacagataaaatggctgctgcaccacaaatgccatggaagatcacctaaatcttgtacttctgttgaagaacttccattttcgataaataaaagccgatcaagaacattggggtaatgatcgataagacattcaacatcactgaatttatggtggggttaaagagcaaccctccaagaatatcgccaaaaccggcttctagtccagctgacagtgcaaaagcactgaataataatttcgaaacgagtaattttcgtttcttaactaatttaatccctacataaatcaaattaagcaagctgataaaacctgtcagaagaagcatgaaaatattgggaatcgaatgacgaaagacataactgactaaagcgtttgaagaaccaagaaagacctcagcgggatatcctgaataatttttgaaaggactagatacatagatacgtagtgtttggccttggtaattttctggcaaggtgacaaaagagagggttttcccaggattcacaagaccatctgctacttcttttttattggtatataaaagtttatcatttaaataaaccgtcattttctgatgatcgcccaccaacagcaatgtcgggtagtagtgctcattggtgattttacgttccattaccaaattttcattggtaggaatattaggcaaaaaattcacatagttactgtcgaaagttgtttctggttctgctgcagaataatacagccaatcttcctgtttttcaatagaaggaagactgatcactggattaatcagagcagaaatatagaacaagataattcccagagaaaaagcagaaatcgttaagaagggaattgcattcttcaagtttagtttgttattttttttaacatatatgaattctcctgttttttatccacgtctagaataaaacaaaacaattgattaagtcaaatgataatgggtgttatgccagaaataataaaataactaataaaaaaaatcatttaaaaaagcggactcatattatttgaaaaaatcattaatcgttataatataaacgtaatatacaaaaatatcaaaaataaaggagaactgtgatgaaaaaaatttctaaaacaagtatccttctttcttttacaacattaattattatgctttttcctttactcatgattgttattccaaaaatgttagggttacccatcgctattgtgaagagtgacgcaatggaaccaacatattcctctggaagtttattatttgttaaaagtgtggatgcagaaaatttgattgtcggcgaggcaatcacttattttgtgaatcaaggggaacaaatatacacgcggcgaattgctgcaattgatcaaaatgagcaagtgatgtatacgatcggagacattcaagaccacatggaaacgaccaaaatcagaaaaagtcaattacttggccaacctttgttccatttgcctcgaatcggtcatctagtcacgagcgaaactgtttctattgtaaaaaagctttatttggttttcaccatttatattacagcaaccacttttttggtgatgatttctcagatcaaacaagggaaacgaatggtaatgtaagttccactaatcaataacaaataccgcaaacaagttcagcaagtgctgtcctgtttgcggtatctttttgtttagaatcagatttgttgtttattctatcccttttttttagcttcatactggaagcaaagtaaggatcaatccagcgccaagaagtccaagtccaaacaaccaatccttaagggtgactgaataattcactgcataggttcgaggtgcatcaccgacaaatccgcgagattccatggctgcagctagaagttctgaccagcggatcgatttgaccatcagtggaatcagtggttttaaggatagtttggaataagtgattcctcgagatttcagactaaactggatgttgcggtactctttaggaatcataggtgccatatgaaaggctgccattaagccataagcaaaaacaggaggcaagcgaagttgctgttgtaaagaatagatcagctctgttagtgaggtcgtagcggcaaagacacttcctaatgtcccaaaacaataaacgcgactggcgagacgaatgccataggcatatgccgctgtcgtgctgccgttttgaccttcttggaaaaataatagcccggtaaaaaagatcccgactgcacttaaagacaagagaaaaagtaacttgagcaattttttcagaggcagataaaccaagagcagcaacaagaaaaataaagtcaaactgctatttagcaacaaattatcttgaaaagagacgagcaaagccagcgcggataaagtcagcagcttgactgttgggtttcggtacttcattggaagactcctttacaaaatgattgaaatcgaatgttcggtcacaaaaatctgacagaagacgcaaatcatggctaatgatgaagaccagtgtaccgctggccgctttgtctgccaataacgacatcaattgccaagactgccgcaaatcttgtccataggttggctcatcaacaagcaaaatcgggatctcacgatcgatcaaacaggcaacagctaatcgccgttgttgtccttggcttaataggaaaggagaatcttcctgtttctcccatagtcccaattggttcagcttttcagagagatcctctctttcttgaccattggctaattcttgtgccacggaggaagctagaaactgatcctgcgggttttgcatgacccagctcatccgatcgaaaggacgactgcgagaggtcaagcattgctcttggtaatagatcgttccatcatagggaacttgctgcaacagggctttaaaaaaggttgattttcctatcccgctttttcctgtgatgcctattcgttctccggtcgaaaagacttcgtctttgatcagcagagaatgtctgccaattggcaaacgaaaattttcaaaccgcaagaggggctgcggctcaataggaatgagggacggtttaatcatagtttgtcttagctgctcttcttgctctaaaagcaactgagaaggaaccgactgaaaagcatctgttaataggagccattcctgcacccagtcagcgaccggtgcgacttgatggtcgattaaaagaattccgattttctttttttgttgaatttctgttaatttttcaagcaatgattgggcggtcagcgaatcgagattagcgaaaggttcatctaatagaagatagcggctttctaaaacaagacagcatgctaacgctactagttgtttctccccacctgagagggttgtcagcactcgatcttctaaatgacgaatctcgcaaaaatcgagtgccgtctcaatacgacgagtcatttcgtttaatggaatggctctgttttccaaacaaaataacagctcttctcggggagttcgcatacaaaactgcgtatcgggattttgaaacatcaaactaacggacgcaatccgttgtacaggggataaatcagtaaaatctttctcatcgatcacatagtgtccagattcgaacccttgatccgacaaaccggctaataagcgaaaaaacgtactttttcctgaaccagaaggaccatagatccctttgatttccccaggatctaattcaaaggtagcggtaagtttttgctcatcaatcgtaaagacacaggagtctagtgctaaactcattctttcacacggcttcgtttgaagcaagtatgttgagcaatcggatagctattcaaaacccccatttttgctaagtgatcacaaaccactttaacaaggacagctgaaaaaaggagcgcggaaagcagacggatcacgaaaatagtcagcagtaattgccactttaaatcaagaaagctggaacggatcatgccccaaataaaactggtgacagtcgctcccaaagctcccaggatcaaagaagaccagccgaattttcgatagcgaaaagcggcaaagccagcctctgtgccgattccttgaagaaagccgctgacaaagataattggaccataaaagttacccatgaaaacctccaacaaagcggcgatcatttcagtaatcgtggctgcacctggttttcttagtacgtaaccggcaaatgcagacgccataaaccaaatcccaaagagaaattcattcgctagaatggcgaggccaaatggagttaacaaggtgctgagtaaaacccccaagtgaacggcccctaaataaacgacaccgaatacgagagaaacgatgcctaccatgatcacatcctttaattgccacttactcatgcaaagaggcctccttcaacgagggactattgactgaaacggttccttcaagaacataatgaggcagcttttcgtgtgcataggccagtgcttgttcaaaataggcgaataattgagcggctgtgccagatagcagcgtcacgtaatgggccgattgcggttgtaagcccatggcatccgccaacgagacgatatgcgcaatttcttccatataatcttcacgtccaaagacataaaaagaatatttgcactgaacgatgaacgtaccttttgcagtaatttgctgatgatttggccgttcatgcttgccgctgagaaaggcatcaccagccagatctcctggacagcctttcgaaaaagtgaactcaccgaccaaatgtgtttttgggtcataggcattgacaaaaagagctgctgccgcatcaatcacactggcagcttcaccacggtagagtgtactgaaaagatctgtctgctgccaaacggctgtggtatcggtctctttgatgcttcgaagaatgtgagaggcaaaatcatctttcattggataaagactgatgcggcatcccgtgatatcgatttgattcattgaacaattttccatagtattcttcctttcgaatgattttctgtctacaaaaaaagcgttcctccttttctatccacgggtagacagaaaaatgggaacgcgaaataagctgcgcaaccacttccctacgttggtattaaccaaatcaggttcaaagggaccagacaaactgtctatctcagcataaagcgcccctagtggataattcgattcaattactttctgagtgtagcacagacgatttgaaagaacaagtcagacagcgcgagcaaaaagacaaatgaatcactgcagatatgaaagaatagacatataaaaaacatctttttaggtgttgacagattgttttcccttgtgtaaagtaaataatcgaaagtaaaacgtaagtgttacgatttgtgaaaatcaaatcgtaacaggctctctggtgtttttttaggagaaatgatcgttttgctaaatcaaaaaggggtgctggtaaagagatgaagaaatttttaaaaataacaggtatttcgcttttaaccatagggttggctgcttgcagtgtgacaaaggaatcagcgaatgaacagacagaacaatcaagtgatccaacgattcaagtcctcgctagtttttatcctatgtatgattttactcgcaatgtggtgggaaatgaaggcaatgtcgaattgttgatgccggcagggacagactcacatgactatgaaccatcggctaaagatatggcaaaaatccaagaagcggatgcctttgtttacaataatgagaacatggaaatgtgggttcctgccattgaatctacattgaaagaaggagatgtcaccattgtgaaagctacggaggggatggtgttgctgtcgggtgatgaagagcatgaccacgatcacgagcacgatcatgaagaagggcactctcatgaattagatcctcatgtctggctagcaccaagccttgcaatcaaacaagtagcaagcattcgtgatcagctaagcagggcttatccagaaaagaaagctgcttttgaaaggaatgctgcggcctatttagaaaaattgcagtcattggatgattcttatcagtcagcatttaagaatgccaagcaaacgcattttgtcacccagcatgctgcttttggctacctcgctttggaatacggactgacacaagttccgattgccggactgtctcccaatgaagagccttcagcggcacgtattgttgagttgaagcattttgtagaagataccgggatcaagacgatttactttgaagaaaatgccaaagacagtattgccaaaacactggcaacagaagctggtgtcgatttatccgttttgaatccgctggaaggattgacacaggaacaaatggatcgtggggaagattacatttccatcatggaacaaaaccgagacgcattgatgctgactacttcacaagccaatgagaaagaagtgaaagaagcagagaaagaaaaaaccgtttataatgggtatttcgacgacgcagatgttcaagaccgctcactcacggactggaagggacagtggcaatcggtctatccttatttgaaagacggcacgctggatcaagtttttgactacaaagcaaaacagaataaaagcatgacggccgaggaatacaaagactattatacaactggctaccaaacagatgttgcagaaattacgatcacaggagatacgatggcatttacctttgaagatggcacaaccaagaaagcaacctatcaatatgtaggcaaaaagatcttgaattaccaagcagggaatcgcggcgtccgttatttgtttgaatcaaaagataacgatgcagccttcaaatatatccaatttagcgatcactcgattgcaccaactgattcccatcattttcacctttattttggcaatgaaagtcaagaagcattattgtcggaaatggatcattggccaacgttctatccgactgatctgtctggattagaaattgcacaggaaatgcttgctcattaaaaaaaagattgacaattactgctcttttcgtcaaagttaaactgatagaaaggagcggtatttttttggaaaaaacattgaaaaaattagcaaaagtaatcgatcacatgatggatcatgtcgcgttgttcggtggtccgagtgttgtcagtaatgatgatttagatcattacttagatccggttttttatttgattttttgtgcagaacaaaagacgaataaaagaatgctgacagacaaagagtttgtcgaatgggtctatacggaaatgatgcctcaagagattccttatgatttgaatttcctcccctttgctaaattagctattgaagatttttattattgcatgtataaagaacagcacatcacaaaagaacaataccaagagattatctttgttcttgcagaaaaacagcctgtgttttactctcgcatgtcaaaaccgcatttctggtcttcagagaagaaagcggcaatgctagagatgcttcatgatgtcgaaccggaagatcatgatttggttccgatcgaacatccctatgaaaatcaacgatcgccaaaaatcgtcccttttccaataaaaaaagttcctgaagctagcgaagaaagaatcgctgcatatcaaatccgtattgatttggaaggtttcaagccgccgatttggcgaaggatgctcattcctgcaggcattagttatgaacaactccataatatgatccaaattgcttttcaatggcaggattcacagctctacctttttcttgccggcaataattcaatcgatgtgccgaacacggaacctacaaatgcattagtgatcgaccatgatttccaaacctgccaaactctgacctacatttatgacatgggtgctgactggacccacaaaataaaaatcgagaaaatactgacggctgctgaagcaggtgaaacagtcacgcctgattgtctaaaagcggttggtgatgtgccaaacgaagagcaaccagaggaacaaagagaatcagtgaatgttgaaacaatcaatgaagaactccgggattactgggaatctgatccgtccgactaatttttttctcggaataagtgcaataatcgattcatacgatggtgtgacgaatctgtttaacagttcgtgacatcttttttgatcggtccttgtttgattaaggtgttgaccattcatgaactacatcaagttagctgatatagaaatactcatttctgtggcgacacgcctggtttgatacagattctaactttttaactctagagccaatgattcagcagattgattttcgagtacattcgagtacaatagttcgtaatgatactggacaagcgacgatgctctatctgctgtgaggtgcatctttcaatcgctctagaagatggactatctgttctggcgacagctgagagcaagtgaggggagtttttatgaaaaaacgagaatttatcgttcaagatttgcttagtaaaatttatcaggaagaatttattgaaggaaaattaccgaatcaaagagaacttgccagaaattatggcgtttcccgctttacgattcaacaagcaatcaaaaatttagaagaaatcggcatcgttcgtgtggtccaaggatcgggaatctttatccatgagaagtgggtcaaaaatcccatgatctttaattccttgacacggactccttacgatcggatccactccaaaatgatttctttgagtaaagcacccgctaccccagatgaacaaaaaatctttcagttagcagacaatgaagaagtttggacttttgaacgggtgcgaatcgtcaattataagattgaacagctagaaacgtcgaagctaccggtaggattatttcctaatgtcactcaagaggtagtagaacattcaattcagcgctatgttgagagttgcggatatcggatttcccactacatcagcagttataccccgattgcgacttcaatggcccagtcggcaatcttgctgtgcaaacgggggaccccagcgatgcaaatcacgaatcgggcaattttggaagatgggcgggtctatgaattcagcaacatcgtcgccatcgactatgcagtcacctatattcgacctttcgatcgagaaatccatcgttcacgcatcgattgatcggcagaggaagagccacaaatttcctagacgataaatcaaaaaaactcagagctctgattcaacaatttgagtcaggctactgagttttttaggattattatttaaggtgtgattagtgtaccatccggcgttctgctttgtgtccactcatgggggcggtaaacgaccggaaaatcagccgcagcttcttcatcaaatgtaataccgatcccgcttttttccattggatagaagaagccgcctttgggttggggactgccaacaaacacggattgggtatttgccggcaactcgattgtttcttggatcgcggcattgtgcagatggatattcaaatgcgtattgactgccaagccgactggactgatatcagaaggcgtatgccaggcaattcgaacccccatcgcatcgcaaaaatgagctagcttcaatgctggcgtaatgccgccaatctgtgatacatgggcccgcatgaaatcgatctgccgatttttgactagttcttgccattccattggattattgaacaattcacctgttgcaatgggggttgctgactgactgcgtaattgtgtcagccagtgactttggtcaggcggcagaatatcttccaagaaaaagagctgataaggttctgctgctttggcgaactgaatggcttgattcggatggaggcgttcatgaacatcatgcagcatttgaaattggttgccatatttttctttgatcgctgcgaacatcttcaaagtcgtttccatataatctgtctgatcaaagtaagagccggagattggttcttcgggtgtttgcagctggcttggattcccgccatagaacccgagctggcaacgaatatagcgataaccggctgccaaaaagcgatcgatttcgtgatagagatcgtctaaattatctgctaccgcatgagtataagcagggatcgcggttcttgcttttccccccagcagttgatacagaggcatatcagctaactgtcccttgatatcccataatgccatatcaataccagagatggcattgtttgtgatcggaccgttgcgccaataggaattgacattcatgacttgccagatgtcttcgatttcattcgcgtctctacccatcagaaggggacgtaaatattcgtcaacgactgttttgactgctaaaggacgaaattgaaacgtactacagcctagtccggaaattcctttattggtttctactttaacgacaacaaggttatggcgatcaggtttgatcgcaaaggatttgacgtcggtgatgatcgttggtgtcattttattcactccaatttttgtatctagttgatatagccattgaaacacgcagagcaaccgctgtcaatttggtccaaaaaaagatggctatggctcataaaaccagtccaattttagatggattcttatttatttgttgatacatagcctttttggtctgtttttttaataaaaggactggttttacaagcgggtgcagccatgctactatgtgtgtgaaaacggacccacttgaaaaggcgcctcaagattcaagtccgttagcaaacaacaggaggaaaaaatgatgatgaaagaagacatcgtaaaacagatcataaaagatgttggtggatccgagaatatcaataatgcttggcattgtatgacgcggcttcgttttgatttgaaggatgaaaagaaagttgactatactgctttagaaaaaatacctaaagtggtgggaacgaaatatcaaagcaatcagctccaagtggtgatcggtacagatgtagcggattattatgctccattagccaaagaacttggtttggatgaaaagagtcaagagtcttcagagaaaaaaggcgctgtctcgttgtttatggatacagtctccggtgtattcggaccaattgttccagcaatcgctggggcaggaatgattaaagggttgatggcaggattggttgccttaaatgtgatttccaatcaaacagatacgtatttagtcattgatatgatcgccagcggcgtatttaccttcttgccattttttgttgctgcttctgctgcgcgcatctttaaaacgaatcaatacttggcgatcgccattgctgcaacattacaatttccaacgatgacgaatgcagttgctgaaggcaatatttcggcctttcgactgtttggggttttaccagttcccgttttcaattatgcgggtaccgttattccaatcatttttgctgttttagcattaagctacatttatcgctgggtagacaaggtattgccgcaagttctgcggaccgtctttacaccgacgatttccttgtttgtggctggactgattacactgacagttattggtccaatcagtattcatttaggcaatttgcttgcagatggtgtagctggcttgtttacgatttctcctgtattggcaggaattgttgtaggtgctattcgtccaattgcgatctttaccggattacaccatgcaatgacgccaatcgcattacaaaactttgccaatcaagggtatgatatgttgatgccaatgatgttcatggcaaatatggcgatcaccggcgcaaccgcagcgatctactttaaagtaagatcaaaagaagaaaaatcaatcattttgtcctcagctgtgtcaggattgctgggcatcactgagccagcattgtttgggattttatcaaaatataaaaaagcatttttagcagctaccatcggtagttcgattgcatcagcgttcatcagcttttttggcgtaaggatctatggctatattttatccagtatctttagtttgccggcttatattggtgaatactttatctatgcggtcctaggtattgtcttggcgatcggttcctcttttgctctgacttatttcctagtccctaatcaagcagaaacagaaaccttcaccaacgaacttgatttgcatgttgtaacgcaaggagaatacattccattggaagatgtacccgacgaagtgttttcaacaaaaatgatgggtgaagggtatgccattcactctaaagacggccaaatctattcgccagtcagtggtgaagtcacttcggttttcccttccaaacatgcggtgggaatcaccacatcgaatggtgtggaagttctagtccatatgggaatcgatacagtttctcttgatggcaaaggctttgaagtattcgtaaaagtaggagagcaagtaaccccacaatcgaaactagcagcgatggacttgccttatatcgaacaacaaggcaaagaaacgatggtcatcgtcctaatcacgaacatggaacgtgtccaacaattttcaggaacgatcggtcttgaaggaaatcatcaagccggtgccctattagaaaaggtaattttaaacgcttaaattcaagaaaaaaagaggtttaacaagaggggagatgcacctggcaaaaacagctgcggcatattctgtccaattgttcgaaagaaagagctgcgacaagacttttgttacagctccttttttttaccatcagtgacgttgagtaatataggcagctataggtttactatatttctcaaaaagtttttgcttttcagaagggttctgaccttgattaaaatattcagccagtaaataaccgatatagggacctgtggttaatccagaagaccccagtccgctggcgaccactaatcctggctcactgggaagcagtccaaaaaatggcgcaaagtcagaagtataggcccgtgttcctacgcgaactgtcattggcgcagcaaacaatttctcgggggctgccaaaaatgaaccgatgccagtcagcaattgttgctttgctgcttcagtgggagtcagatcccaaccgccatcattttcgtgagtcgctcctaaaaggatcttcccattcgcaaaaggaatcaaatcgccttcgccttctaacatcgccactggccaatcttttgctgacgctgtcgtttcgaaggagagcagctgtcctttttggggacgaacatcgacgtggtagttcaagtgttctaacagttggcctaatcctggtccggcggttaaacaaacatgatccgctgggatttctgcgtatgtagtagaaacgacccaatttttttctttataaagtctagccttcccttggacgaaaacgaccccattggtacgggcccgttcttctaggaacgctagataagcagcgccatctagtcgacctcctccggaaattttcaaagccggtagtggtttgagcaaaggtaaagcttgctgcgtttcagcaggagaaagacaggtgatttgaccgatttccggtgcctctttgcgccgttcctccgccagttccgctaatgctgccaactgattttctgggcgaatgatcaatgtacctgagcgttgataaatatctgtggtcagtgagaaatcttgtgccaatttttcgaaaaaagcagccccatctttagctaattgataccatcgtttgtttcgccgtttcgaaagccagggggaaatgatcccggcactcgctttagtagcttgtcccgtagggtcgtcaaccacggtcacttggtacttcgtcgtatctagataatttgctaaggtcatcccaatgatgccgccaccgataattacgattttttccataaaactgcaaactccttttttgtttcaatcattgttccatattcttctcaaaaaatcaaagactgaaagtttctgtcgaaagtgattcccaaactgttcccatttcaaatgactggattttctcgtataatggacatggaaaagaggatattatgcaatcaatcaatcaagttttaagagataaattcggttataccagctttcgggaaggtcaagaatcaatcatcaatgccattctttctcatcaaaatgttttaggcatcatgccgactggcggaggaaaatctgtatgttatcagctcccagctttattgttagacggtctgacattagttatttcaccattgatttcattgatgaaagatcaagtagatgcattgaatgacatgggtatcccggccgcttatatcaatagtaccttatcagctccggaaatcaaccaacggttaaggcaagcatcgaaaggagaaatcaaactcctgtatgtcgctccagagcgtttggaatcagatcattttcgcgaattgctgcgctatgttcctatatccctactcgctgttgatgaagcccactgtatttcacaatggggacatgattttcgtcctagctatttacgcttagcggaaacgatccatagttttgatcagcggccaacggtggtggcattgacagctacagcaacgccaaaagttgcccaagatattgaacgactgttgctgattccaccagagaaccaagtgaaaacgggctttgctcgcgaaaatctatcttttgaagttatcaaagagcagaaagatacttatttgctgacctatttaaagatgaacaaaggacaatcagggattatttatgccagcacacgcaaagaagtcgaacgaatctatcgtttattgaaacaacaatctatcaatgctggacgctatcatggcggattaactgaagaagaacgtacgcaaaaccaagaagattttctttttgatcgtcttcaagtgatggtagcaaccaatgcttttggtatgggaatcaacaaaagcaatgtgcgctttgtgatccacgcccaaatccccggtaatttagaatcttattatcaagaagccggacgtgccggacgagatggtgaacctagcgaagccattttattatacgctccgcaggatttgcagattcagcagttttttatcgatcaatctgagtccgatattcagtatcgtcaaaatgaatacctcaagttgagagaaatgagtcaatatgggcatacacaaatgtgtcttcaacgttacatattgcggtattttggggaagacggtcccgattgtggccgctgcagcaattgcttagatgaacgagaacaggtagatatcaccgttgagacgcaaaaagtgttgtcctgtgtgaaacgaatgggtgaacgttttggcaaagcgttagtggggaaagtgttgaccggatcagcagatcagaaagtcacccaatggggatttgaaaaattgccaacctatggtttgttgaaagattggtcacaaaaagaagtcaatcaactcattgactacttaaccgcatcaggctatttagtcccttcggaaggacaataccccctgctcagtgtgtcagctgccggtgtagaggttcttttaggcaaggcaaaggtttaccggaaacaagccaaagtacgtcaattggtcgtcgatgacgaattgtttgaccaattacgttccctgcgattgacgctcgcacaagaacaaaacttgccgccgtatgtcgtcttttcggacaagacattgcgggaacttgcggagcagcagcctaaaactcctatcgaatttctacagatcaaaggtgttggtcaaaacaagttagataaatacggtgatgcgtttctggctgtgttgaaagaataccgagaaacaacagaaaaatagtgctgctttacgattcaggaaaaaacaaggagaaaccaagatgctgaagattcgttatgcgcaaaaaagggatatgacattctggttagaactagataatcatttgtcaaaagcaggattagcaaaaaagttccaagatcaacaggcgttgatcttgaccgatgaggaagaacctgtggggattcttcgctaccaattgttttgggataccattcccttttgtaccatgctggtggtcaacgaatcccagcagagaaaagggagaggaaggcacttcctccgcctttgggaagcagaaatgcggaaacaaaggtatgggatgtgtatggcctctactcagtctgatgagagcagtcagcatttctatcgaaaatgtggctacaaagatgccggtgggttgcttatggacgtaccaggttttgaacagccgttggaattgttttttgtgaagccgttgtcgatacagcctcagtctgtagaatcagaagaatgaaaaaataggagcgataggcatgtctttttttggaaaaatagatttcaacgatttatcagagacggatcgagcaatttatcattatatgtccagtcaaagtgacaagattccttatatgcgggtgagagaaatcgccatcgaatcccatacatcggcctcttctgtgatgcgctttattcgtaaattaggctatgaaagttttacggagtttcggtcgcatgctaagatgcctcaggttgaaaatgctgatatacttagcggaagcacgttattaagcgctgatcattttcctaaaaacattgagagtaaattgagacgagtggctgagaaactgattgagtgtgagaatattattttttatggtattggtgcttctgcatcaatgtgcgagtatgctgcgcgtcgattttcaactttaggctgtaatagttttgcattagtcgatcatacatatccgatttttgcaaaactaaaaaatacatctgataatatggtatttgcgttatctattacaggagggacaactgaaatcatagagttgtttaacggatttaaaaacaacccggactttacaacggtcgtaatcacaagcgattctgcaagcacactgggtagaatgagcgattttgtattagattattcggttgatgtgaagagaattaataagcacgaggatttaacaagtcaaattccctgtatgtttttgattgaagccttatcagaggctgtgcgccaactcattacatttgatagagattgaaattattcatgaccttggtacttcgtgtaccaaggtgcttttttttctaatttgcttctcgtgtaccgatttattagtaaatgcacgatgaatatcggactttttgtatactcaaggagaataaagagaggatgaagaatcatgaatacatttccagaaaattttttatggggtggagctgttgccgcacatcaggttgaagttgtgtggaatgttgagggtaaaggtgtaagtattgcagatgtgatgaccgcatgaggaaatggtatttccagagaaattacagatggtgttatagaaaataggtattatccaaatcatgaagctattgatttttatcatctttacaaagaggatattcaattgtttaaggaattgggtcttaaagtattgcgcacatctatcaattggacaagaatttttccaactggcgatgacaaagaaccaaacgaaaaagggcttaaattctaagatgatctatttgatgaattacttgcaaatggtattgagccagtcatcaccttatcgcatttcgaaatttcctttcacctatataaagcttatggtggatttaagaataaacaattaattcctttttttactcgttatgcggaaagtgttatgacgagatacaaaaacaaagtcaaatattggatgactttcaatgaaatcaataatcaagctgatggataacataatttacacacctggactaattctgcttttttatttgatcaaaataagacccaagcgaataaggaagagataatttatcaaggtgctataaatgaattgattgcgagtgcacaagttgttaagttaggacacaaaattaaccccaaatttcaaattggatgtatggtggcaaacgttccagtgtatccatattctagtaaacctgaagatcagatgtcggcacagaaagaaatgaatagacgttttttttatagtgatgtccatgctagaggagagataccccaatatgtcctaaagaaatgggatcggaaaaactattctattgatatctcagatgaagaaaagaagatattaaaagaaggtaaagttgattatatcggctttagttattatatgtcaggcactgccactactctggatgagaatggcgagttgatcaatgatttttcaaaagccaaatggttaagcaatccacatgtgaaagcaagtgattggggttggcaaattgatcctgttgggatgagatacactttgaatatccttgaccaacggtatcagatacctttgtttagtgttgaaaatgggtttggggcctgtgatacagtcgaaaatgatgaaattcatgatcaatatcgtattgattatatccatgcacatatagcagaaatgaaaaaagctgtcttagaggatggagttaatttgttaggttacacaccttggggaatcatagatatagtgagttttggttcaggtgaaatggagaagcgttatggcatgatttatgtagataaaaaaaatgacggaaaaggtacactaaagcggttaaaaaaagattcatttaaatggtaccaaaatttatcgcatcaaatggagcagacatctgatgattggtacaaggggtttcattaaggtacagaagccattaagctggtacagcaaccaaccttgatgaaacccattgaatatgaaaacgtttttatttatagtttgtttataatgttgataaaaaaaaacgtttttatgtggtgatgataatgaatacacgaacaacaatccgagacgttgcaaaagaagcaaatgtgtcaatcgcaacagtttcaaaagcgttaaatggcgttgatgttgttaaagcatcgacgaaagcaaaggtcatagcagctgcgaagaaccttcattatgtgcctaatcttatgggaaaggaattaaagaaaagtaggacgaaaagaatcggattttataccacaagtatcactggtccgtattttagtgttctgattgaatccatagcaagagaagttgaaaaacatggttacgctttaaatgtgtttatttcaatggaaaaagaagttgtcttgacgagtattctgggaggtgctgtagatggatttattggatttgaagatatgcttgatcaagaagatcttgagataatcagaaatgaatccgtcaatgccgtttttattgatcgtaatattcaagatcatacatttggtagtattgttttcaattccaatgaaagcgctgaatatgcaacatcttatctgatagcgaaaggccatcgtaatattgcattcgtcaaaggctttgatggtgtttatgatagcgatgaacgattcaagggatatcagcaagcactaagaaaagcacacattcctctaaagccgcattatctaatagaaggaagatttgaagaaaatttcgcatatcaatcgacagaaaaatttttgcataagcaaaaagatttaccgacagcatttctagcgggaaatgatcttagtgctatcggcgtaaccaaagcgattgaacatgcaggctatcatgtgccgaatgattttagtgttgttgggtttgatggaatcgagctgttgaaatattttcgaccgtctttaacaacaattgtgaacccaatcaaagaacaaggggagcttgcaacgcaacatttagtaaagctgatcaatggggatgtttcaggaaaatcctttgtattaaatggaagattggttgagggcgaatcagtatatcagtttaatagaaatgagtgatataaatgtatttgggaatagatattggtggaactacaatcaaatatggatttattgatgataaaggacaagtttattgtaagcagagtatcaaaacgatcgataatagacatcaattcttggtaaacctacaaacaattattgaagagagtcagaggcaagaaccaattgaagggattggaatcagcgcaccaggaattattgatcaacacggcacaatgattacagcaggagcaatcaagtccatctatggtgttcgtctaaagcaagaattacagaagataacgaaagtaccaattgttatcgaaaatgatgccaatgctgctgctatcgcagaacaatggattggccatgctcaagggattcccaattacatatgtatggttctaggaacaggcataggtggcggtattatttatcaaaatgaattgatcaaaggtgcccatggcatggcaggcgaatttggctggatggttattaaggaaattaatgaaagcgttgacatagaggcgatgtctttgaatcagcgtgcagcagtgattggtggtttatgttctcgttataatgaaataatgttaaagaaagattcaaagttcaaaccaatttgggatgcaaaagaaatttttgctaaagaagaggatgacgatattgcccacgacctcattcatagtttttatgaagatctatctgtcggcatattgaacttgatcagttgttttgatcccgaattggtattgattggtggtggcataagtgcaaacacgttatttttagagcgattgagctccaccatttcaaaaatgacagaaagacatcaaagtattcattatttagtgggaaaaacgatcgcacctataaaagcagctaaattgatgaatgatgctggcatggttggagcagtatatcaagtaaagaaactgattctaaatgaggcaacaataaactgaaagtgaggggaacagatggaaacttccgtgcaaaatgcaaaacgctctactaataagataaaaaagtggttctctgttttttttgaacaatgggaattgcaaagtatggtctggccaggaattatctttatgatcatttttaactttattcctatctatgggctgatcattgccttcaaaagatatacagtcatcgacacacttgaaacagcaccttgggtcggctttgaaaattttcagatcatattaaatgataaatttttttggggatcagttgtaaacacgcttggtatcagcttcttgaagctactgataggttttgttttaccgattatcttagcaatcttgatttttgaactcagacaaggtgtatttaaaaaattggtccaaacaatctcttacatgccttattttctatcatggattgttctaggcggtatgttgattaattggctgtcaacaaatggattactcaatacaatattgagtggacttggtttttcaatcaaacatgaaaactatcttttatcaacgaataaatactggtggattgcggtattgtcagatatatggaaaaacactggttggggtacgattttatacttagctacgttatctaaaattgatccctcatattacgaagcagcaaaaatagatggggcaactaggtttcaacaaattatgaaaattacattaccaatgctaaaaggaatcattagcttaaatttgattctgactataagtggattactgggatccaacttagatcagacaatggttttgatgaataatcaaaatcaagcgaaggcggaagtgattaattcatatgtatttagaatggggatagcgcaaggcgatttttcttatgctactgcagttggattaggtgtgtcaattgtatcagtaattttattggtatgttcaaatcaaatgaccaaacgactaaatgacaatacgtccgtattgtagaaaggagcgttgtatggaaaaaaaagtgatgaaaaaggatgtagatagtcgtttattcgacattttcaatattttgatcttaaccattttcaccttgattatcgttattcctttatggaatgtggtggtatcatcattcgcctctggaagtgttcttgctaaaggtgactttgtattctggccttctgaactgtcactagagaattatcgagcagtattcagagatgggagtatgttgcaagctttctttatttcagtttctaaaacaatctttggtgttttaacacatgtatttttctgtgccatgatggcttatgctatgagcaaagcaaatctgaaaggcagaaaattatattctgcgatgggtatcactacgatgtttttttcaggtggaatgattcctacgtacttattgtttagacaaataggtttgttaaatagcttctgggtttatattataccagcgctgttaagttattatgacgtcattatattaatgaatttttttagaaatgtacccgattcattagaggaatcggcaatgattgatggtgcaggtcattggcgcatttttttgcaaatatttttacctctgtccaaaccagctctagcaacaattgccttgtttaatggggtaaaccaatggaatgactttatgacagctagaatttttattactgataagctctttacccattacaaatgaaactatatgagatcattgttcaatcacagacacaagggatgcaaaacatcggaacggctgtggcagaaagtacaaccaaaggtgtccaacttgctacaatcgtggtcacaacgattccaattctgattatttatccattactccaaaaacatttcattgctggaatgatggtcggagctgttaaagaatagaaaaggggaaaacaaaaaatgaaaaacttgagaaatttagttttgctgtttagttcggtgttgttgctaggtgcatgtggagggggagaagataacgcaagtcaagaagcaaaggatgtagatattagtgagcgttataatctagataaaaatacgccagcatggcaattggataataaggaagaagtcacagaactgacatggtatgttaatgctgattggtggaatgatgaatggggaaatgatgtcgttacaaaaaaaatggaagaagatttgaacatcaaagtcaaatttatcaaaggtgatgatactaacttaaatacaatgttttcaagcaatgatatggcagatatcgtcacaatttttgattcaaactcacaagttgcgcaaaaagctgatagttgggcctattcattagatgaacttgcagataaatatgatccttattggcaaactgtagctgcaaaagacacattaaattggtttcaattagatgatggaaaaacgtatggatatcccaattattctaatacagcagaagattatgatagcggtttaattcctgctaacacaaactttttgattcgaaaagatgtatataaggcaattggtgagaataattttgaaactgcggatgatttcatagcgggaatgaaatctatcaaagagaaatatccagaacttgttccctttggtttcaatgcgttgggtgatggggctggatctttaggtgatgttttccaagactatttgggtgttgatctagaaacaaaagagggtaatttttataaccgtaatctagatcaagagtatttaaactggttaaaagtgttgcgtcaaattcatgaggatggaaatttgtcggatgatagtttttctgatgatggtacagcttttgaagaaaaagtgaaatccggtcaatacgccacaattatggctagtggtacagcacaaatgagtggttttttacaaagctggttagctgaaaatcctaatggtgagtacattgcaatcaatggaccacaaaatagtgaagggaaagagcctaaattaaatcaaagtggtattactggttggatgatcaattatattagtaaaagtgctaaagatccagctaaggccatgcaaatcttcacttatttacaaagtgaatacggcggcattctaactacttttggtattgaaggagagactttccaatatgacaatgatggtaaaattgaattactgccagaagtgcaagagatgaaagataatgattcagatcgattcaaaaaagagtatcgactaagtgagtttattttctttggtcatgataaatatcaatcaatggctagtgaaagtactcagacacctgccttgatacagccaagagaatggggagaaggaaaattataccctcattttattctagaaaatattgatcctagttcagggactcaagaagcacgtaatctctctgcaatcaatacaaattggtatacaacattagtctgtttgattcgctcttcttcagaagaagaatttgatcaagtaatctcttcatattcaacatttttagatcaaaatggttggtcagatattgaggcaattagaaacgagaaaattgctgagaataaagagaaattaggcatcgaataaaaaggtggtagtcagtaatgaaacaaatatttaatattgatggtgaagtatacagtttcctacaaaaaatatatcaaatgatgctattaaatctattaatcatcttttctagtttgccaatcatcacagtgccttgtgcattgattactggctaccagcttttaaaagaatacaatcagcaagaagttaccctaacaaaatacttcatgctgtttagaaaaaatctgattctttcattcaggttaatcatcgctttctgggtgatctttttcttactgtttcttttactagcattcactagaagaactatatttcaatttttgatattactttttattgcattttttattgtgtttctttcgaatgtattcattgtttgtaccagccaaatgtccattcggtccatagtggagttttcattagggataacgttaaaatacgtaggttgtaatattattggcttagcgataatgcttagtagttttgttttacctgtgtttttacctagattagcattagtatgggcgttatttggaataagtattcctatggtttttcaagttatgatccataagcaaattatgaagcatgtaactacaaatcaaatagaacaggagtgatccattgagttttgaatattacacgacaacagatgaaatgaatatgtttcagcttgaacaatctccgtttacacaaaataaaaatgagtttgaaatcaatgtcaatagccatcaaacttttcagaaaattgatggatggggaacttctttgacagattcttctgcatatttagttgataaatgtttatctgaagagcaacaaatcgcagtcatggaagcgttatttgattcaaaaaaaggaatcggtctttcaattctacgaaacccaatgggtgcatctgactatgcgcggcatatttatagttatgatgatatggaaaaagatcaaacagatgagaatctgattcatttttctatcgcacaagatgaagaaagtatcattcccctaacaaaatatgctaagaaaatgaatcctgaactaaaattatttatgtctccttggagtgctcctggatggatgaaagattctcaacaaatgattggtggaaaattgttgttgaagtattatgatacatatgcccattacttcaaaaaagtgattgacagttatcatatgcatggattagatatatatgcgattacaccacaaaatgaaccgttgtttgtgccaccgaattacccaggaatggagatgctggcggatgaacaagcaacttttgttgctaaatacttaaaacctttgtttaatgataataacattcggacaaaaatattaggctatgatcataactgggatagaattgattatccattagaaattttggataaggcagaagcggcctttgatggcatagcttggcactggtatggtggtaatgtaattaatcaatcaagagttgctctattttatccagataaagaaattcattttactgagggatctggaggagattggataccagcctttgaaccagctttcagtaatctaatgagaacagggatcaacatttttagaaatggtgcaaaatctatgacgctttggaatttagcgctagacgaaaataatggacctactgttccgggatttggaaaaagtacttgtcgcggccttgtaaaagtggatcaacaaacgaaaaactatgaattgacacttgattattttggtctggctcatttcagtaaatttgtccgccctgaatctgttcgaattgaaagctcgaatgatcggcatatccaaagtgttgcctttcagaataataataaatccattgttgttattttgtttaacgatagtgaaaaggatgcatctgttaagataacgatagatacttattcaatggatacaatctatttgtcagcgaaaactgcgatgacgattagagaaatatctaataacgaggagtaggcggaaaatgatctgtttgaatcgttatgtttctaaaaatcatgatgcggaaaatgggaaaatcgtctttgctggttcttctttaatggaagaatttcctttggaacaattgtttctcgataaagaaataattgtttataaccgcggaattagtggagcaacttctaaagactatcttgaaatttttgatcgattgatactctctatacaacctgtacatctattgatcaatattgggtcaaatgatctagcagacgagtgttttgaggatagtcacttattagatagctaccgccaaattttcagtaaattgaagaaaagtctaccacaatgtgcagttacttttattaagttttatccagtaaataccggaataatgcaagacgtttcaaaaaaacaaggcgagcaatggctactgcaggcttcaaagtatagaatcaatagccgtgtgattgaagcaagtgagaaaatcagcaagcttgccgattcaaatggatatgagacgattgaagtcaataatttgcttatagatgaaactaaacagcttgatactttgaataccaaagatggcatacatttaacagaagctgcatatagaaaaattttccctttgatatatcaacatgtggatttagtacgaaaggtgaataaagaagcatcggatggtaagaaatgaccattcgatgcttctttttatgaaacacattccaatctatgtaacaggttgatttgaaagcgatttctataggaatgtccttcaaacttacctataataaacctaccgataaaaaagcaaaggagtatcatcaatgaaagaaaaaatgatggatgcgatgcagaagttttcaaaagccatgtttgtaccggttctgattttgccaattgctgggatcttgattgccattggcaatgtttttaccaatgttcgtttgatcgaacgttttccatttttggataacccaatcaccacaggttttggcagcattctctctgcctcacttttaccgatcttaacgaatctcggcatcatattttgtgtagggatcgctcttggtctggccaaaaagaaaaaggcggaagcggcgtttactgcattactaggctatctggtgtttttatatgccatgaacaaatttatggaacttcgagggatgcttgtagccgccgatgcactccaaggatcaggacaagcactggttttaggggttcaagtcttagatatgggggtatttttagggatcatcttagggatcatcgttgcattgatccacaaccgtttcatcgacactaccttcaataatgcttttcaagtctatggcggggctcgctttgtcttcattgttttgattccagttgttgtattgttcgccatcctttcttcgatcgtatggccggtgattcaaacggggattgatggattaggcggcattattcaagaaacaggaaacttcggtatcttcttatacgggacgctagaaagattattgattccaactggactccatcatttgatctatacaccatttctatatacttcccttggaggcgtcgctgaagttgggggccaagtcttcgaaggggctcggaacatttactttgcagaaattgcggatccggcagtaaaggttctctcgcaaagtgtcatctgggatgcacgaggaatttcaaaaatgtttggcttacttggtgcctgtctagctatgtatcagaccgcaaaaccagagaatagagtcaaggtcaaagctattttgatcccagcagtggtgacttcctttattgctggggtaacggaaccgatcgaattttcgtttatgttcgttgcaccagttttgttcgtgatccattccgcattaagtggactgagtatggttgcattgaatatttttggctcaagagcgattggtccgaatggctttattgatttccttttgtataacttgccgttagggattgaaaagactcgctggcccatctatatcgccgttggcatagtatttttctttctctattatgctcttttccgctttttgattaccaaaatgaatttgaaaacagtcggtcgggaagatgaagggaatgaaacaaaattgtattcaaaaaaagagtacaaagagaaacggttagcaggagctggtgttggagtgacggcagaagtaatcccttcatctgtaccaacggactcgatttcagcattgatcacgaaaggtttaggtggagacagtaatattaaaacgattgacaactgttacacacgattgcgtttgaaactaaaaaatccagaactagtggatgagacattgctaaaagaagaaacccaagccaaaggcgttatcaagaatggtgagaatgtccatgttgtttatggattgactgtaccaaaagtacgagaagaattagaaaagtttcttggacgagaaggagagattgaatgatgaagaatttttcagtagtgattgccggtggaggaagtaccttcacaccagggatcgtgatgatgctgttagataatcaaaaccgcttcccattgagaaagctgacactttatgataatgatgaagcgcgacaaagaactttaggtgaagcattgacgatcttattaaaagaacaggcaccacagatcgaattttcttatacgacggatccgcaagcagcttttactggtgctgatttttgtatggctcatattcgagtaggcaaatatgacatgcgggaaaaagacgagaaggttcctctacgccatggtgtgttcggtcaagagacttgcggacctggcggtatcgcttatggtatgcgcagtatcaccggaatgttggaaatcattgattatatggaaacgtattcgccagattgctggatgttaaattattcgaatccggcagcgattgtagcagaagcctgtcgtgtgttgcgacctgacgcaaaagtgttgaatatttgcgatatgccagtgggcaccttgcgacggatgtcgcaaattattgataaaaatccagcagacttagaagttcgttattttggcttgaatcattttggctggtggaccagcatcaaggacaaagaaggcaacgaatacatccaacaaatcagggaatatgttgcacagaatggctatctcactcaagttgaagtggacacccaacatacagatcctagttggcaagaaacccacaaaaaagccaaagatcttttggctctgacaccagagtatttgccaaatacgtatttaaaatattacttatacccagattacgtttatgatcatatgaaagagcatcccgaatatacgcgttcgaatgaggtcatggaaggaagagaaaagcgagtcttcgaccatgcgaaaaaaatcatcgaacaaggatcggcagagggtatcgcatttgaaatcgatgctcatgcaacctttattgtggatctggcacgagcaattgcgttcaatacgcatgaacgaatggtcatgattgttgagaataacggggcaatcgctaactttcctgatgatgccatggtggaagttccttgtatcgttggctctgatggaccagaagctttggcacaaggcaagataccatctttccaacaagccttgatgttccaacaagtcactgtggaaaaattagtggtggaggcatatgtggaaaagagttaccaaaaaatgtggcaggcgttaaccctttccaaaaccattcctagcgcaaaagtagccaaagatctcttagatgatctggtctcagaaaatggtgattattggccgggactccactaaaatgtttcacatgctgagaaacatttctgatcaaaagatgtcactttgaaaaaccttacaacaattagtgttcgctaaaaagtctgaggatgacagaggagatagaggatctgaatgataaacgagagggagtgcatctgtggtgcagtagttgatggctgcaagctggatgtttgccaaccctcttgtcaatcattcggatttttttgctggaatcactgacattctaaatgtttatcaagaattcaaagggagatgagcaatggtctttttgtggggatcttttttaagtatgctaaaatagaaatgaattagcagagataagggagcgagaggaatgtttttagggattgatattggaacgacggcaataaaaatcggtttgttggaagaacggaaaatcatttatcaacgttcttttcctatttataccaaaacagaaaaaggtcgcacacagtctgcgtcagaaatcatagctgtacttttgaaagggatcacggcgattccctcctctttacgagagcaaataacagtgattgggttcagtacagcgatgcatagtctaatgccagtgataaatgagaaatttgaagaaatctatatttggtcagataatcaggctagccaagtgattgcagagtttcgtcaatcctcattgtcagaatcgttttatcggcagactgggacaccgatccatgcgatgtcgccatttgctaagttgcttcacttcaaatccgctggcggttttgatggcaagacaaaatggtatgggctgaaagaattggtgatgcttttatttaccggagctccttggatcgaccgaagtactgcatcggcaacaggcctctactcccttgaagaaaaaaattggagtcaagagattcttcactatttggacctttccattgaacagtttgcgccaatctgtgacacgaccgatcggtttcctattgctgcgtccgctgccgctcgctatggattgaatgaaacagtagagatcatgtgcggcgccagtgatggctgtttggcggcttatgcagggtatgtatcgactggaatcaaaaatagtttgacgatcggcactagtgctgctgttcgaaaggtgacggatcaaccggtgttcgatcagcggcaaaatttttgttattaccttaaagaaggtcaatatgtcattggtgctccgtcgaataatggggggtgcgtccttgcttggatcaaagaaacattggcacaagatcctgacactttctatgaaagcctcccaagaatcattgaagaaaccataatcggcagccatggtctgcgcttttttccgtttatcaatggggaacgggctccttattggacatctgatatcaaggcgtcttatcatggtttgacgattcaacatactcgggcagatatgattcgtggagcaattgaggggatgttgttgaatattggtgttttaaaagaaatggcagcaattaccgatgaagtgacgatcagcggtggcgttttccaatcgaaagccattgcacaattaacagctgatatcttgggcgtgacatgttatttgtcaccggcaaacgaaccaatttttggtctttatgatctttattttggtcatcgtttggcagcaagagaccacttgcagaccattacgccgaatcaaaaaacgagcgcagcctacgcgtcgctcgctgaacattattttgactagcagaaagggttgcggctgaagtatcagcgagattgaacaacaagattgaacgacctgaaagcaactgaatggcttcatttatcgagtagatgcgaagcgagccagccagatagcaggggtgatcctagatttttttggctattccatatgttgaagccccggactcttttagttgatttcggcagtaaatgcctctacgaggtactccattagcagtaaaagctttccgtaaaaactcgtatattggatgttctgcgtatcatatggtcgttcatcagtgacaccaaaagaaaaatttgctagttgatgggctcggtgttcaccattgccgcagaaaaggacagtggggatttgatgatcattcgctagttgcattttttctagcactttctgtgtctcccccgatttagaaatcgtgatcagcatactgatgttgtcgatattattactaatgataccgccggaatcagaagcactcaccagtaaagttttaataccattaaccaacatttttttatgaaggtattctgctatgataccagaaaagccagtggcataaatggtaatgaatttatcattgttttgagcataaatttctttgatcgcatcaatagaggctgcaatgccttctgtgttgatctgatagttaatggctgcttcagtggtcatttgacgattcagccgattttttaagaaataaagtaattccaaatagccggaaaaacctaatttttgtgctaatcgcaccagtgttgctggagaagtataaagctcttgcgcgatttttcgcaaagggacgccttcgattttgtccgtatgagacaccaaataagtgaggatgtgctgctcgctttcggaaatttttttcctttggtcaatacatttaagtccatgctattgctccttttcgtggtaatatcatcatacaatgaagagaaacagaaagtaaaacttttttctttatcctttttttaaacaaccttcttacaccgtcttcgcaagagaagatggataagtttggttgtttatttcattataagagattataatttcttatatagaaaaaacaaaggtggaatacaaatgacgaaaccctatgggactgttttgattaaagccgcgaaaatcatggattatcttgcggaagaacccaacaaatcgttgcaagagattgcagctgctacagacttaaccaattcaaccgcgttaaagattctcgaaacattacagctgatcggctatgttgcaaaggacaagcaaaaagaataccgcttaggatctaaactcgtcaaatatgccaataaaaatattcaagaacttgacttggtagagatcagcctgccatttttggaagaattgcaggaaaaagccgatgagacgatccatttgggggttttgacagcgaatgaaatcttgtatgtcaataaactggaacctcaaaatcaaaccattcgcatgtcgtcgaaggtgggaatttcaagacctttatatagctcagcgatggggaaagctgtattagcagaattcgatgagacaagctatgaagcttatttagatgaaacacctttacaaccttatactgagaacaccatcacgaatgttcttaaattaaatcaagagttaagagaagtgcgtcagctgaagatcgcttttgatgatgaagaaatggagaaagagattttttgtatcggcgcggctcttttgaaagatgaggaaattgtcggtgctttctcagtcagtctgccaaaataccgattgaccgagagctataaacaaacattgcttcaagaaatacgtgccacaaaagataaaatcgaagcagccatttgaaatacttttggaaaccccttgcaaaagaaaaaagaccaggtataataaagataagatttctttataataaaacttaatttccaaataggaaattaagaacggaggggtttatgaaaaaagtagagcgattatcaaagttaaaagcctgtggaatcgttgcagtcgttcgaggcaccacaaggcaagaagcgctggaagctagtcgtgccatcgtccgaggcggtattaaaggaattgaattgaccttcacggttccgcaagctgctgaagtgattgcagagttagtcaatgactatcaagaggaccaagaagtgatcataggagctggcacggtacttgacgcagtgactgcccgcttagcgattatggctggcgcagaatatatcgtcagtccgacatttgatcgcgatacagctgagatttgtaatttgtatcaagtaccttatttgccaggctgtatgacgatcactgaaatgaaagaagccttgaaatcaggcgcagacatcatcaagctgtttccaggaagtgcctatggtcctagtatcatttccgctttcaaagcaccattgccccaattgaatattatgcctactggcggagtcagcttggaaaatatgtctgagtggttcaatgccggagtggtcgctgttggtgtcggtggtaatttgttagcgccagctgctagtggtgatttcgagaaagtgacagcggttgcttcacaatatgtggccaagttaaatgacattcgaggtaactgagatgactagaattattaccttaggcgagattatgttgcgcttatcgactagttctggtgtacgcttggagcaaagcggacgttttgctgcacactatggcggtggtgaagcaaatgttgctatctctttagctaactatgggcacgacgtctcttttgcaagtaaagtcccggcaaatgatctcggaaaagctgttacccatcatttacgcaattacggagtggattgcagtctgcttctaagcggtggtccccggctgggaacttactatatggaatctggagtaggagaacgtgcagcaaaagtcatttatgaccgtgcagggtcaagttttgcggaaatcaagaccaatgaatggtcagaagcgatctttaaagatgtcgcacttttccatgtatccggcattacaccagcgttatccgagacgtggcgggatttgaccctttcacttgttaagcgtgcgaaaaaagcaggttgcaaaatcagtttcgatatcaattatcgtggcaaactgtggacgacaaatgaagccgccgcctttctaaaggaaatccttcctttggtcgattattgttcggcgggcaagttggatgcacaagtttttatggagattccagcctatacagggcaaggaaatgagttgctgtattattaccaacaaatgaaccagcgttatccgaatattgaactgttttattcgacaaaacgagaagtgctttccgccagtgctaatacattgatgggtactctttggcataacggccaatatgcagcttctcaagaacaccgcatcgatcctattgttgatcgagtaggcggaggggatgctttttgtgcaggcgtcctgcatggcattctaagtgggtattcctctcaggaaaccattgactttgctaccgcagcatctgcattaaagcacacgattcatggagattgtaatcaatttacagaagcggaagtagctgaatttttagcagccggatctggaaaaatcattcgctaggaggaaccagcatgcaagaaatggaaacccgttatacacacagcccagaagatattcgacactatagtaccgaacaattacgcaatgaatttttggtagagaaaatttttgtacccggaacgatccagttgacttatacccataatgatcgcatgatctttggcggagtaacgcctacggatcaaccattagagtttcaattgagcaaagagttaggcgtagaatactttttggaacgccgtgaactaggtgtgatcaatattggcggtgcgggaaccattgaaattgacggcaccaaagaagacatgaaaaagcaagacggatactatatcggaaaagaaacgaaacatgtagtcttttcttcaaaagatccaaatgatccggcgaaattctatgtatccagtgtaccggcacatcataaatacccgaatgtaaaaatcagtatcgatcaggtcaaaccaatggaaacaggtgaaggcttaacgctgaatgaacggaagatttatcagtatattcatccgaatgtgtgtgaaagttgccagttgcaaatggggtatacgattttagaaccaggtagcgcttggaatacgatgccttgtcatacccatgaacgccgtatggaagcctatgtttattttgattttgccaatgaggacacaaaagttttccatatgatgggtaaaccagatgaaaccaaacatttagtagtcgcagaagagcaagcagtcatttccccaagttggtcgatccattctggagtcggaacaagcaactattcctttatttgggcaatgtgcggggagaacatcacatacacagatatggacatggttcccatggatgagttgaaataataaaagaaagaaggatgaagatggatttttcaatggatcactttcgtttagatggcaagattgcattagttaccggcgcagtttatgggattggctttacgatcgcccaatctttggcagcagctggtgcaacgatcgtctttaataatttaacacaagaatcagtcgatgaaggcataaaaaattatcaagcagccggcatcaaagcccatggctatgtctgtgatgtcaccgatgaagcagcagtcaatgaaatggtcaaaaccatagaggaagaagtaggtgtcattgatatcttagtcaacaatgcagggatcatcaaacggatcccaatgttggagatgtcagccgctgatttccgtcaggtagttgatgttgatttgaatgcgccattcatcgtttctaaagccgttttgccttccatgatcaaaaaaggacatggcaaaattatcaatatttgttctatgatgagtgaacttggccgcgaaaccgttgctggttatgcagctgctaaaggtgggcttaaaatgctaaccaaaaacatttgttctgagtttggtgaagcaaacattcagtgtaacggcattggccctggttatatcgcgacaccgcaaactgcaccattaagagagatccaaccagatggatctcgtcatccctttgatcagttcattgtggcaaaaacgccagcagcgcgttggggagagcccgtagacttagccggtcctgctgtcttcttggcttctgacgcttccaattttgtcaacggacatgttctctatgtggatggtggtattttggcttatattggcaaacagcctgagtaatcctcctaagttcctgatttctaaaacaggcgaacttagcaatcaaaaaagctcctattcttcgcacatcctcaatggattttgcaaagagtagggggtttctttgtcgaattttccgataaaaaaatgaatgggagaacctcttctctgagaaggcggatcgtggttctagccaagttcgatcaagaagaagggggggagccgcttactaaagaaccaacagttagttttcttgcagctttgctctagtttttttctttatttgataaattttttagactattcaattgtcagtggatatgagtaaatagattaggggttctatcgattttccactaaatcaattgataggaggattaagatgaaaaaatggtttctagtagcaatgctatttatttgtagtgtctttgttagtacgcaaaaggcagctgcccaaacggagggctcgatcacagattcctcttattatcgcaacgctttaaccgagaagattcctgcagatcatgcttttattatgagaaatggtgaatcaaccacgatagaaaaagtgtctggagtcgtgaatagtgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggttgtaataatagatatattggtcaatttttgttttcaattcatctaaactccgatagacttctccgtgaaaaatctcttgctttaataaaccaaagaagttttccataggtgagttatctaaacaattccctttacgagacatactctggaagattttatgctgcttcaatttattcttataagcattcatttgataggcccatccttgatctgaatggaaggttctacgaaatggacaatcatttgtcatctggattgcttcttctaatccttccattatggctagtgcgtttggtttttcagaaatccgataagatagaatttcactattgtagaaatccatgaaaggatctaaatacagctttttctgacgaacgacacctgtggtgtctacttcataatacttaaactctgtggtatcagttgtaattttttggtgacagatatttgtataaaaccgacgatgaatacgatttttggcgacagtgccaaccttcccacgataagaattgtaccgtcgagattttcgagtgtaagactttacttcgatacctagtttttttatcagacgttgaatcttctttttattgacatgaatcccttgattctctaattctttttttagtcgcagacagccgtaatctttatgatctttgcgaatttcaagcattttttcttcaatttcttggtctgggtttggtctgtcaaaccgtttctgccaatacatataggttgctttaggaaatttcaatgtttcaagaagctcaactagtttgaatgatcctcggaggctggcgatgattcgtgcgattgattcttgcgtctttgctgggcttcctgttttcgcagcttcctcaactcttttaaaaaggcattctcaatttgaagggatcggacttgcttttctaatgccttgatacgatcgcgttcttcagttgttgtattttcttttttgttttctttttttctagtcaaagtaagtggtcgccctttctcttttgagagcccctcaatacctgcttctctgaaattacgcatccaattggcaataagcgcagggttgttcatttctaaagtgctagcaacttctcgataggacatctcacttgtttgatataactctagcgtatttaacttaaattgaacagaatatttctgattttgatgctttctcaatagaccttcctctccgtattcacgatagacattcacccaattacttacttgagacttgcttgaaataccgtatttgttggcaagataccgatatccgcccacgccactaagatattctttaacgatttttagttttaattcaaaaggatattttgccatacaaataacgacccccaaaagttagattttttggtctaacttttgggggtcgcttcatagtgaaagaatagttactgggattaattctgtaaaagagagcgctgctctgataagaaatgttgggtattatcaagggcaaccggtcaatgtcaaggtgactgtcaagatgttggaaccttcaggtgcggatatgcttatcacgaaaaacgaatttctaagattgaaaatatgggcaaatggtacatcagaaatcacctatgaatttttagacgataagatgcagccaattcaactaaagacgacttttaatgaaatgggtttgaacaaatggaaagacatacgaattcctcaggctgctactgccatagaacatatctttgctgctcccgattccacgatccaatacagcgaagacgagcaaggcactttgacgttaaaaggacaaggaaacgcagataattggtcagatgatgcttgtaaactggcaatcacaacaaaatctatcactagccactcagaacatcgaaaacaatgaagtgatcactcgtttccaacaaacagttccttacactgaaacaaacaattctcgaacaactttatcttacagaatcgaaaatccagatcaaaatcagtttcaattaaaaggagtcgagatcaaagatttttctggaacggatcgaacaaattggtttgaccagaccatcgatgatgaggggaatttgcttgttcatgcaaaagcttctacactaaaaaaccgggccttttatgacaatagttatcagtttatcattcaccacaccttcactggaagtgcagaacaaccggtcgatcctgcactgatcgagaatgactgttttcaacttcaaccaattctttatgaagatattggtgatggtgaacagttaatcggaaaactttctgcgtccatttactactataacgaagtgaagatcaaatttgttgatgaaaaaaatcaaccgctcttagattcgggggaaatcagagggctgatcacccattctgttgatttatcttcgttctatcccaccattactgggtactatccgatccgagaagaaaaagaccacatcattgtcatgccaggttctcaagaagttttccatcgttacaaaaaaggtgtcccactactctttacattaaaagaccgacaacaaagaatcgtgattccacgcttttctaaagaagtcaagttatcttatgacctttcccatgacagccatcaaagcgtccaagttgttgcccaatatggagagaaaaaacaggtgctaagaaactatgatgtgggaaatacacaaacggaagactcggtcgttttcgaagtaccagaagaatggcttaataaagaggtaaaattatatctagagaataaagagggggatcaatcagcagcagaaactcgcgtgtttgttcctgagtcaggaccaaggctgcaagtgccggcagtcttatcttttggaacacaccctattccagcttttaatcagtatctttttgctgaaagtcaaccaatcaaagtggaagataacagtcgcttagaaaaaagcaaatggacagtgaaagtaaaaatcgatacgccgcttaaaaacagtcagcaacaagagctgcgagatgcgctgatttttgttgataaaacaggggatattctcttgtcggacaaagcacagccggtctgggaaggcagtggatccgccacattagctgagaatcgattgaagctgttattgcgaccaacggatcatgtcggggagtatcacggctcgctggtttggatgtttgaagatgcgcctcagtaaaaaaattttctatccgtaaagttcaaccttttttcataataaaacaaagtaagaaacaagcccttaattcactaaggctgcgacatccacatagctgaaataaacaagcaacgtgtttttctccctttggaaacacgttgcttgttgttgattggtaaacaaagaattctaaccgaattacagcaatatctcactgctgagagaaagattcgcttctttgattgcttgacaaatcaagcgagcaacgattaaagccccttgatcattcaagtgagtattgtcactgataccttcgggataattcggatattcgttttttgaaagatgcaaaaaaaactggcgagcttgcctagttgcaaatgtggaaaaatagttttgcgtcatcgtgaatatatccagacaaggaatctcaaaggcagcagtaaaatctctcatagcttctggataaggtcacgcggctaggggattcaagtcattatgctgatggaacttcaagcgagtgatagaagtcagtaaaactggatttgcttgcttttttgtgcaacagcaataaactgtgctaaattttcttgatgttcttttggcgtcgttcctcgttcaggatctgttttctggtcgttgtggccaaaccgaatcaagaaatagtctccgggtataagctgctcgtcggctgctaagaggcgtttttcttgaatgaagcttttggttgaacgtccattcatagctaaattaatgaccgtaacctctggggagaggaaggttggtatttttctttccagccagtttccggacccttgtcagtcattttagttgcagcagttgaatcaccggcaataattagtttaaccatcatccacctctaaaaatcaaaataatccgctgcattttggtaacagataccttcaacaaattcttttaactgtctggtatcacttggtgcttcgccgcgaagaatgagttctcccaaccattcacaaaaaactcttcggaaatattcatgtctggtatacgaaagaaaactacgggaatcagtcagcataccaacaaaatttgctaacacgctaccatctgcaaacttcgtcaattgctgacgcatgccggcacgggtatcgttgtaccaccagccagaaccgagttgaagtttgttgttgccttctttttgataacagcccatcagcgctaccagcacatcataatcatttggattcaatgaatacaaaatcgtttgcggaagagcctctttcctctccgcagcatccagtaatgcttgaagtgggctagtgatcggctgatcgttgatgccgtcataacctgtgtcaggtcccaattgattgagcatattcgtgttgcagtttctataagcatgaagatgcagttgcattgtccagccatggttgtgatattgttcaaataaatgaagcaagagggcagagcgatagactgctgcttctgcttctgtaatgacttcctgatttctcgctttttcaaagatagcttgaggagacacgctgttttctaggaaatgcaagtgatccaatgcgtgatcggataaacgacaattcatttggtgaaaaaaagtaattcggcagtcaagtgctgttaacaagtcttcatagctatcgatcctgtggccaacaactgttgctaattgatcgatatagtggttaaacccactttgttggatatttaaggctttatcaggacgaaaggttggtaatacccgaaagcggctttcttcattagccaatttgcgatgaaatgctagtgaatctgtcggatcatcggtagtacaaatgagttgcacattgctgttggcgatgatttctcttctgctaaaggtctttgattgcaatttttggttgacgatttgccagatttctggcgcgttttcttcattaatcataagatcgacaccaaagaaacgttttaactccaagtgggtccagacgtaaagggggttgccgataattttaggaactgtctggcaccaagcaataaatttgtcataatccgctgcttcgccagtaatcaacgattcatctactccacatgcccgcatcaaccgccatttgtagtggtcaccggccaaccaagcttcggtgatatttcggaaaggatgatcatcataaatctcttggggatctaaatggcagtggtagtcaatgatcggcattttcttggcgtattgatgatacaaatctttggcaaagtcattcgttagtaaaaaatcatcatttaaaaacattggcttcctcttttcttcgtttataaagtgacaccattcttgaagatggcgatttctcgaacattgtttgcttcattacgggttttggtcccactagcgaccgcaatgatcgcttgaataaaatcagcgagaacgtcttccattggttcatataataaccgacctgcattgaaatccatccaatggggtttcttctcgaataattcttggttggtggcaactttcatcgtagggacaaaggcaccaaagggggttcctcgtcctgtcgtaaataagaccaactgacaatcagccgaagcgagagcagaagcagccactaggtcattaccaggtccttcaagaagactgagaccgctttcgcggattttatctccgtatttcaagacgtcgacgaccgcagaggtgccggatttttgcgtgcagcctaaagacttatcttccaatgtggtgattccacccgctttattgcctggagaaggattctcataaacaggttcgccatacgaaagaaaataatctttaaagtcattgatcagatgaagaatcttttcaaaagttgcttggtctttggcacgagacatcaatacttgctcggcaccaaacatttccggtacttccgtcaacacagtgctgccaccttgagaaaccaagaaatctgaaaatgctcctaataacgggttggcagtgataccagaaaatccatctgagccgccgcattttaagccaacttttaattcacttaaaggcacatcttcccgccggtcgtctttggtagcttgcagcaattcgtgcaataatgcttcacccgcttcgatttcatcttggcttttttgagcgactaagaatttgacacgatctgtgtcataatcacctagcttttctttaaattcagcgaccgtattgttctcacatccgagtccgaaaacgagcaccccaccagcatttgggtgttgcacagcatcaatcaaaattttccgggtgttttggtgatcttgccctaattgcgaacacccataaggatgtttgagaatcgtgaccgagtcaaaggttcctaagttgggatgactttgtttgaaattttcgacgatgatctcagcgattccattgatacagcccactgtgggtatgacatacaaatcattacgaatcccgactttgccattttttctccggtagcctttaaaagtcaattggctttttggatacactactggttgtaggttcggctcataggtataagccagcgttcctgaaagattggtcttgacattgtgggtatgtagccactgtccagcttttacatcggacaaaagatgaccaatagggtaaccatacttgatgacgtgatcgcctttattcaaatcaataagtgcgatcttgtgaccttgaggaatctcctctgtaaaactataggatcgcccttcaaatgtaagctgtgtctctttcgtgattgcatgcaaagcaaccgcaacattgtcttttagatgcaatttgagaaaatcgcttttgttttttatttctgtcataatcattccgcctttttttgagtcggctcattttttaatgagtcaacgaggtgtcgagaacccttgtttgaaagtagcactaccatttgtgaaacttctttgttgaacacgctcaagtccactccccataacttttcttgtcctagaataaaactgacttgttcagaagagtcgagggcccgtgccttttcaaagagagctagcacagcttcatcgtcttgacaatcggtcgttaaatacaagtaaatcagtccggctaatgatgcaatgattcttggcggcagtaactgttgctgatgatgacggagcaacaacggcaagagacgtgctttaaattttgagacgctattcaaggcgatcgactgcagttgatgatgaacataaggatttttaaaccgttctttgatctgttccgcatactggatcaattcttcttgcggcaggtctagcataggaatcagttcttcattgaatagctcatcaatgaagcatgtaaaatcaggatcaagcatcacctcttcaaccgttgccaaaccagctagaagggccagagggaccatggctgtatgagggccattcaaaagatgcaccttccgttcacgatagggggtcaggtcttcagtaaagattacattcaaactcgcagctggcaatggaagtttctgagatacagtatgcgatgggttttcgatcacccacaacatgaatggttcggcagtgaccatcaaacggtcctcatacccgtgtaattgattcaactcctctgcttttgattgggggtagccaggaacgattcggtcgactaaactacagcagaaagtgttttcattttctaaccaagtatgaaagctgtcctctagttgccacagtgagcaatattgttggatacacgcttttaatttttctccatttcgatcgatcaactcacagggaatgatcgtgtaacctgatttattcgcttggtaccgttgatagagcagcgcagttaacttagccggaaaactttttggcggcatatctgtccgtttgtcttgaggatcaaaggcaattcctgcttcagttgtattggaaacaatgatgtccaagtcatcaatttcagctagagctaaataatcctgccattgttcatagggattcaatacgcggctaatcgtcgtgatgatctcagaggtttggacaggacggccgtctgctaatccttctaaaattaccgtatacaaatgattctgctgcgccaatagagatcctagaccttgttgaattggttggactactacagcgctaccattgaagagaccttgcttattcatctgctgtagctgccagttaaaaaagcctcgcataaagtttccttcgccgaattgaatcactttttccgacttgcgagtaggatgagtcatttcagttatttttttcattgtaacctccaatattcattgatttataatgaacgtctgccattttgcacacgttaacatttttggcaacagccaaaagcattcaagaagcgaatgctagagggaatctctgattgttagttctgtatctaaaaggtattgtttttgtgaaacagagccgttgattgaatctagaagcagttgtgccccaagctgactcatttcaaaaacgggcttgctaatggttgtcaacgggggattcgtatattttgaaaacgggacattgtcaaatccaataatggcgatatcggcagggattgcaaggccatattcaagacaagtgttgattgcgccaatggccatgtcatcgttggaacagaaaatcacttctggcggctctgcaagttccagtaattgtttggcacattttcgaccgctctcgatagaatagtctccagtgacagcgtattctgttggaaacgctagcccgtgctcagtaagagcccgcatgaaacctgtcttacgctctatactggaacgaaaagttggcttgccttcaatgatcgcaactttcttatagcctaactgaatcgcgtagtcaatggcttgataaacgccttgcgcatcattgcttgtgacatttaaaaatgatggtctatccatttgtcgattgagaacgaccactggcaaatctaagtgactgatttcttcgatgaaagtgtcatcttgatcactttgactcataacgatgatgccatccatccttggcaagtcctcaactggactggtaagggtcgtcatatcgtggaccgctaagcgatactctggcggtagggtggtattgattcccttgatcacttcaaccaaaaagcgatccgatgtacctgccgacaaattagaaaagtaaaggccaataatatacgacttctgattgactagacttttggcattgacattcggcgtataatttaaagaacgcgcaatgtcaccaattttcttttttgtggctggcttgattagtggactgtcatttaacgctcttgaaaccgtggtatgggagacgcctgcgatttttgcaatatctttgatagtgaccatatgtatccctcgactttctcattggttttagcatatatcctaaagagaggaatgtcaatatatcaataatgcacacgttaacttttttctttgaacctgtattcacaagaaattttttatgctagaatggacatatcttaagaaatgattctgtcagtaattacaggagaaatctcatgaaaagggtagggctaatcagaaacattcaacctttttttataacattttccttccagtttctataattagaagcgttttaataatagcgtttggaagtttcatttatcatcgcacgtataaggatattcagaaaacattggtccaaaatcagcaaaatttcgttcagcaagtcaaaggaaatctcgatcaaaaaattcagatcgctttaaaggatttgcacagctgtgcaaaccagccttttaatagaacctttaaagaaggaaggggaaaagaatggaaattagtattgacatcaacgattatttaaatgaaaagtcagtgacagcaacaatccaagggtatatcgatcagcttcatcaggcaggaggagggaggctgatgtttgcctcgggggtgtatccaacaggttcactgatgttaaaaagtaatgttgaactccatctacaaccgggagctgttcttcgattctcggatgatcccaaagagtatccagtggtggtttcgcgttgggaaggggtgaaacgggaagtctatgcttcttgtatctatgccgacggtgccgaaaatattgcaatcacaggttttggcacgatagatggtcaaggtcagaaatggtgggatgtctttcgcaatcatccagagcagttagaatatccgcgaccaaaactgatcagttttgattcctgtcagcaaatcacattgcgagatgttagtttggttaattctcctagctggacagtcaatccaatcttatgccaagacatcactgtggataatattaagatcaaaaatcctgcagactcgccaaatactgatggcattgatccggagtcttgcaaaaatgttcgtatcagcaattgtttgatcgatgtaggggatgattgtattgccattaaatcaggaacagaagagacaaaagaacgcgtttcctgtgaaaatatcacgatcagcaactgtcaaatgctccatggtcatggtggggtcgttttaggaagcgaaatgagcggagatattcgcaatgtgaccatctcaaattgtatattccaagacaccgatcgcggcattcgtttgaaatctcgtagaggacgcggcggggttattgaggatattcgagtgaacaacctaattatggacaatgtgatttgcccatttacgctgaatttgtattatttttgtggtcccaaaggaaaagaaaagtatgtttgggataaaaatccttacccaatctctgaggagactcctcagtttaggagaattcattttgtcaatatctccgcgcgaaatgttcatgctgctgctggttttatttatggtttatctgaacaattcatttcagatatctcgtttcatgaagtagcaatttccatggcaaaagagcccatacccggaaaaccagctatgatgactggaatggaagagatgaccagtcaaggattctatattggctgtgctaaaaatattcattttgaccgtttagaattagtcgatgttgaacatgccttccatatcgagaatagccaggggattgaagttgaccgttcccaagaaaatggtaagcctctcgtgcttcatggtgatttttcgtgaaacagcggcaaacgttgcaaaggtttggatcatttcatagaaaggaaccaatagttcttgtaagaaagttcttttatgagaaaacgattgtctcgaaaagtttttgttagaactcaattaacaagaaccagtgtcggcttatttttgcctatccttatgagaaaaagctagtgccgtttgttcttttcaaccactctcatggaggcagtttttctattggcaaagaagaattacgcagtagcagtcactatttgcagccagaaagttttctagaaacattgatcgctgagggctatgcaggtggagcaatcgatatttgggaatttggtgagagaaaacatggtgaaagtacggtgttttaaaattttcgttcataggacaaaccactctggaccaccatactcaataacaatcaacagttctgaatctacaataatgcgtattgatggatcagaaagtaaatcagatataaaaacggctggcagcctagagggggcttgccagccgttttatatcgtctgtgctttataagaacttattatattagagaagccaactacgccaaaagggtttccgaaaaaacaattatcaagccgaaagtggtaaaataatgcgaatgctgcttaatttcaataaggaaggatttttgaaatggaaattaaatttttgcaaaaagatcaaccaaactggttggcttatgcgggtcaaattgccagcgtcgattggaaagctgctgcatttgtagcaaataagatgcgtcagagaagctataacgactgggaaggcgtttttgtggctgttgcccacaatcaattagctggattttgtacgatcgtcaaagaggatattgtccctcttcaagtcgccccttttattgcgaccgtgtatgttgctcccagctatcgcggcaatcatcttagtcagcaattggtatctgctgcagaacggcgcttgcatcagatcggttttgatacgatctatattgtcactcagctgtcaggtttgtatgaaaaattgggctatcaacaaattgagacagccaccgatcgctttgggagaaggatgcgtgttttggcaaaaaatgaagaattctgctagtcaagcaaatctctttacttactttaagttagtgttattattaaagtaacaagtcatccattcgagatgagaaaaggagcagaaacaatgacggtgattattccagaatttcaacttcatgaacagactcaaattgggaaagttgtcttaaaagtagccaacttagaaaaaatgattgctttttatactcaagtgatcggactatcattgatcgaaaaaaatcagcagactgctcgcttaggtatggcagagaaaatactgcttgaattgatcaaagtcgaaaatccattgcctctcacaaggaaaacaggactgtttcatgtcgctttccttttgccgactcgcaaagatttaggcaatacattgatccattatttgcaaagcaatgcaccgatcgatggcgccagtgatcatggctacagcgaagcattgtacttaacagatcccgaggggaatgggattgaagtgtatcgtgataaaccaaaatctgaatgggatattcgagaagatggcgaaattgttggaattacaaaagaaatggatgcagagggggttgtcgcagcagcagacagccaacaatcaagtttccccacaggtactattgtgggacatgttcatttaaaagttgctgatttagcccagacagaaactttttatacccaagtcgtaggactgagcttaaaaaataattttgggaaccaagcaaaattttttgcggcaggagattatcatcaccatattggctcgaatacttggatgggcaaaggtgtgactcctatggcagacaatgatctaggattggcttattatacctttgtgctcccagacaaagaagcctttgagtcattgctcacgcatcttgagaaggaaaatgtatcccttactcttgaatcaagtaggcgtttggctttattggatccaaatggcatccaagtcaaaatggaatactaggtaaaaatgatagcttttgatgtttttgaatccttgatagcagtttcagtctaaagacggatggggaaagatcggctttatgagatacttggcatatcaaaaaaggagtgcaggaacatgaaatggtggcatctgatgaatacgctatgggtttcattgattttaactagtttgttggtactatttgttcaagacccatttatgactaattatggcatcgatccaatggcgaaatttgcttacttggcattgattggtattcttgcgattggattatatggcgtccaatccgtctggaaacatcaattaatgaaagtatcaatgacaaaaaaataagcggggacccgtcagtgggtccttttttgtttttgaaagtcagtagcggatgtgaagcaaaaaataccttttagatgatagtttgccgggcagcaagttttgtgcacattgatgaggggtgactggcgggtttgacaaaatagatgccagtaaaaagtatcagggctgtgcggattgattccagcacaaccccatgaaaatcaggagatatctatgatctgataagaaaagccattgaccgttaaaaagttgaatacatccttggtagcaaggaagatcgtcttggtatttgtattaggatggaaactcattcgtggttctttagtgatttcgcgctcaaagaaaatctgaatatctcgctccgaattgcttaagagcccaaatatggagacaacgccaggtggcaagtgcatttttttcctcaaaagatcaggagaagctaatttgactcgtgattcactagtgatttctttgagcagatttagatcaagccgtttttgatcgtccattattaggagataataggcggtcttttttttattggttaaaaacatcgattttgttcgaaccccatcaattccagcaataaagctgtctgcttccgcagttgtacttgcaggcgggtgttcgatcacttcaaaggaaatgttcaagtcggtcagtcttgcagcaacagattcaaaaggatccaatatgatcaacccctagtctcttttttattactatatcataggtataagttttaaaatgcctattcaatcgcatgaaagatagagagagtaacaaaaaagcagcttagctgctagtgtaggtcgttaactttagtgatcgaaatctgaaaacagatctgaaaaactttctcataaagaattgaggagcaaagagatttcgtcatgcgcatggatcgagcgtctgtcagtgagcagaagctgctttttacaggctgattctgccattagttgtcaaaataaacccatttgcttgataaagagcaagtaagcgtctcgttaccaaattatttttccaaagattcataagcagaaagttactgagattcttcggctgcaagtttgagactaaatttagagatcacccacagtagaacagcagcaatcagggtaccaacaaatccaaaaaacatgtctaggggatcgggggtattcataacgcctaataccgtttcgcttaataaattggcaatcagcaagaaaatagtcaatccgagagtataggtgaatttgacgcccatcaataaccaaaaataccctagcagaccaatgatcaagctaatagagaaattggaaatgtgtaaataaaagtcggggaaaatcgctgtaaaaaaggttatatctagatattttgataaataggcaaatagtgccaaaaaaatcagtagtaaatagagtaaagatgcccaaacttttgggtaataatgtagctttatttgatttttcaatatgaactcctgtaatcgattgattggctcaaagccgtagctattgtactgggatagttagggattgttaataaaaaacgcagctagtgtgttttttatttgtttatagtcttttgtaacaaaatagttggctgggacattgatgatcggcagatcattttcgttgtcaaacgggacaaatggatcaggtacaaccaaataatccacttggtctttatcgcggaaataattgattgagacatcataatcattggcgaaataattcttaagctcagaataatctgcaaaaaagaacgctggtgacaatgtggtataactgagcccattacttgcagtcaaaacgaaacagatttttttcatcttatttctccttttttatgattttattcgtacgtatatgttaagggggtgatcgatgagaatggtgtaaaaatactaaaggatcaagaaagtgtcctgcacgtatttaccaaacaatgtttaaaccaaaacagctcggttgtctgtgtctttttatagacaagttcattcttttttactggtcaatcgagtgctgttaattagtgagacctgactaacgacggtctaaatgaaaagcaattatttgctgactctagtttcttttttttggtttcttttatcatagagaagtttgagcaactcatagagagccgtgagtactgcaatgcaaaaaagtaaagtcgtatatctgataagaaaaattagattgaaccataatccgtagaccatcggcataaccacgatcaagcaaagatacaattcgatttttcggcgtctcctcaattgcagccatcgttcatcagacatgttctcgctcctttgatcaagatagaatttccatgcaatcctctatgtgtttgactcaacgtatagacaaatagaagaaatacttagaaacagtataaccgaaaatgacaaaaccacataactaggacggcaatttcgtcctagttgtgtctttgtcatagatttataaataacaattgcataaaactaattgaactggaaatacaaaaaaagcaaattaccgaagtaatttgccggtacgatgcagacgatgggatttgaacccacacgagctaagctcacacgcccctcaagcgtgcgtgtctgccgttccaccacgtctgcttattgtttttgtatactgacagctgattgcagccatcacgtctaaaaaacatgttaccgattatcttcacgtttgtcaatgctattttagggatttataaaaggacatttttcttgctttttattgaaaaaaaatatttaagtggcagaatctggtataatgagaaaataactttggagctttaaggagattgataaatgaactactttaaaaatctgctggctaaatcgattcggcagcgccgttttttgtttacgatgatagcagcgttcttgattggtgtggggctcgctttttatcttacattcatggaaccagtgaatgtacaggcagaaatcactatgcaaaaagcgcaagcattacggcttgtagacaattatcagaattatccaaatgaatctcaggacaagcaagaaacctatcaactgctgctggcaaacaacacattatctaatcggcaagcctcgaatctaatcatggaagaatttcctcgtttcaatcggaccagtgaagagattgcaaaaattcagctgcaattatgggaaaccgctttaccagataaagcctttttaccatctatctggcaattgcagcaaaataaagtggtagcagcgcaattagaagaacaggaaaaagctccttttcttactgttgacaatgcgcagactgctgttgcgttgactattcaagtgttattgggatttggctttttattcctggcattttttgctagcgataatttgctggaagaaaagcgccatttttctctgatccattcctatccacaagtcttccctataaggatgatcagtaaagtcggggtaaagatgattggtcatctggcaacgatcagcctgttgcttctaggaatcactgcggccatgtcggtgatcggacgatggggggattggcactatccaacggctatctattatcatcatacttggcatgccgtacctttctggcaatactttctattggtactcgtgcttttgacaactttgattattgtgacagaattactgggccttgtggccaatgttttgattccaaatcgctatgtttctttttttctcctttgtctttgctatggtctcggtacaatagctagtacaccattcagtaaatattccccttttgctgtttttaatttgcaaaagatcctcacaggtgagtttgcagtcagatcgcaatcgacagtcgggttagggacagctttcatccttcttttcttatggggggtgggagcggtcaccttcttgctgatcgcagataagaaaaactggctagcgaaaggagtcatataatgaaaaattattttctctttgaactacagcaattaatcaaaagtaaaaaaacgatcgggctatggtgcttgttagtaatcgttgctggcgtatacagttttcgtgatcgcacctatcggccaattgagcgaatagacaaaaatgaaattgaacagcggtatttgactagacaatcctttttggatgaacaagcagaaaatccctcagatcattggtccgccgccatggcagtagcgatgttcgagccatggaatcaagcagatagcttacgattaacttccctagctgccaatgattggcaaaagtatgccaaagcaacgagccaatggtatcagctgagtctccaatataccgatgatgaaacaattttcttcacgcctgactattatacttatcagaactattatgcggcttatgatgggaaatacggctatgcctccactgcaaaatggatggaaagtgccagccaattaccaaacaaaaagctttccaagtatgtgttggaacaaaaaacgggtatccaatctgttcagcgggcatttacgaattacttgccgtttctctttcttggcgtgacgatctttttggcaatcgatagtctgaccaaagatcgtcgacacaaaagcttattcttatctttgccggtgacggtagatgagattctttgggcgaagacagcggcactgtttattgtgtcaacactgatgatgatcagtacactcgttttgatttggatcggtgtcggctgccaattcggctttggctcattggacctacccgtcagtatcttgtcttcatcctttgatgcccgttatcctatttcttctgccgatgttttttatacacgccctgttggagttttcttacttcagtgtataggggtaggaatcgtgctgcaattgatctatatccgaggcattcttttgctgagcacactttggcgttcagaattagccaatctctttcttgctggttttggcttgattagtccacttatttttcagagacgctggtttagtgcattcttggataaatcaaatgatgcctatttgtatcaaaattatggtcagatcctttcaggattcagccgtttttattttgggtcctctgagtttgtccttgcgaaaggactgctgctttttggtgtagtgtggctgctgatcgagatcggtctttttgttcgtgtacagcagaagcaatttaagcttgtttaggaggtttggaaatgttagcaatgaaaaacgtaactgtgacatttaaacgaaatgttttggatgatttaacgttggcctttcatcctggagaaatcgtcggcttggtggcgccgaacggtactggaaaatcaacactactcaatgtattgatgaattttgttcagccgactagtggggagatctttctcgatcaaacacagctttacacgtccaagaagtcagaaatggcagctcaccagaaaatctcttttttccctgatcagaacgatctatataatgatctcagcggattagaacatttaaaactttatcaacgaatgtggcgatcagaggaagcgctgattgatcaaaccgtgaatcaattaagaatgactgactatatcaagcggccggttggaacctattcgttggggatgcgtcaaagactgtgttttgcgatgcagatcgtgacagacacgccctatatgttgatggacgaagtcatgaatgggttggatccgaccaatgtggaattgatttctaacgttttaaaagggttgcgggagaaaaagaaatcgatcctgattgcttcccatattttgaccaatttggatagttatgcagatcgcgttttgtttttgaaagatggcaagattatccatgaatacctgggaaagaattctttagtagatgaaccaatttatttaaaagcaaaagatccagagtttttggtttcatttcccgaattaacaacattgacaatcgatcttcaagaacaggtctatttaatcgaaatcagtgatcctcagctgccgcaacgctttattgaagctggttttacagaattttcaattggccatctcgcattagctgaacgctatttaaaattctttccagagaatgactgaacaaaaacgaatgaacgtctaggcaataaaagagcgttcattcgtttcttttagaaaagaatttatttaaaagtcgtaaagttctgtcaatttgaccgttttttttctaaactttttgctataataaatgcaatcttttaaaaaagaatatcactagaaccaaggtaatttgcattgattctactgtcaaaggagaattcgaatgagaaaatttgaaaagtcatcaaaactagaaggcgtaagttatgatgtccggggaccagtcctagaagaagcagaacggatgcaagaagaaggcatcagcatcttgaaattgaatacaggtaatccggcaccatttggttttgaagcgccaaatgagatcgtccgtgacttgattatgaatgtgcgggagtctgaaggctactctgattctaaaggaattttttcagcccgcaaagccatcgagcaatattatcaattacaaaagtttccaaatgtgacgatcaatgatatttataccggaaatggtgtatcagaactgatcaccatgtgtatgcaagggctatgtaataatggcgatgaagtgttggtgccgatgcctgattatcctttatggacggcatcgatctctttagctggtggaaaacctgtacactacatttgcgatgaacaatctgactggaacccagatattgaagatattcgttcaaaaatcacaagtaaaacgaaagccatcgtgatcatcaaccctaataatcctacaggtgctgtctatccaaaagaagtattgcagcaaattgttgatgtggcccgcgaccatgacttgattattttttctgacgaaatttatgatcggttagtgatggatgattatgttcacgtcccaatcgctacattagctccggatcgctttgttgtgactcttggtggattgtctaaatcacatcgtgtagccggattccgggttggctggatggtccttagcggggataagagaaacgttaaagattatattgagggcttgaatatgctttcctctatgaggctttgttcaaatgttctttctcagcagatcattcagacggcgttaggtggctatcaaagttcggatgaactgctgcttccaggaggaaggatctatgagcaaagagagtatatttatcaagcattgaatgacattcctggtttatcagctgttaaacctaaagcggcattttatattttccctaagatcgatgtcaaacgcttcaatattaagaatgatgaacagtttgtgttggattttctgcatgagcaccatgtgctattagtgcacgggggcggatttaattggcaagaaccagatcatttccgaatcgtttatttaccgaatatggatgatttgaaagcaacgaccgaaaagatgcgggagtttttagccacttatcagcaaaaataagtaagcaatagtaggaatgaacaatagtaaaaaaaacgaacagttggctccttatcctgtaccttgtagcaaggcatcggaccagatccaactgctcgtttttttgattgatcgaatatcttaaaatcatagcgcttattgcatatgcttagtcagcagtctgctgacatttttttttactgatgatcattcgatcattgaatttttccagcatttcttcgctagggtctgtcacttggacaagaaccgaattttcatattctctttcgacttttcctgcatagaccttgccttcccaagtgaaggtaatggtgctgttaatcgtcatagaaacacctcgttttaaattgttaaaaaataccaagatattgttggaattgctttcctttttgctattatgtgctaaaatgaagaaaattaaaaatgcgaattcgcatttttttaatgttgaaaaagttggaggagagtcatggcaaattcacaagaatcctttggccaaatcattcgcacgttccgcaaaaagcgcaagatgacacaaaagatgttggcagaagatatctgttcacaaagtgttttgagccggatcgaaaataatgaagaattaccgaatgtattggtcatgcatcaaatctgtcaacgattaggcgttaccttagatcaagtaatgatgctccatgctgaagagatcaatcgaacgaatcaagtgttcgctcaaatggaaagccattttgttcataaagagtaccaagagttattgaccaaactgcaggataaaacgatcatggactatctatatttggacgcagacatgcaaatgtactattactttttagggagttgcgaatatttcttgttccaagattatgaagcagcgattgaaagccttaaaaaaggcttatcctactcttatcagcaagataaaatcaatatctctgtgatggagattcgactcttaagttgtatggggcgagtgtataatgatatgcagcaattagaagaagcacgttttcatctagaaaaaagttaccatggggtgcaagtgctgccggcagaacggatgaccacaaccttgaccaaagtattctacaactatgcagtttttttagcgaaacaagaagaattcaccactgctttacaaattctagaagaaggtatcgatcttgccagagaaaagaacagtttctattttttagaagaattatttgaactgaaaggccatgtctttgtcgctcttgacaatcagcaagcagccgatgaaagttttgctctttatcaagcggtcgtcgatattcgaaattcatcgagaaatggtgtagacctttcttgacttcttactcaaataagagtaattttaaggaagaaaagaaataaggagcgatcaagatgaaaacatatatttatgcggacaaattctttttgaagtcagctgttcatggggcaggttatctggagatcattgacggcaaatttggcgatatcgtcaatgaagtaccggaagatgcggaagtaactgattattctgggcaatggatagctccaggactcgtagatacccatatccatgggttcatgaaccacgatgtcatggacaacgatgcagaagggatcaaagctatgtcagaaggcttattgtcttgtggtgtaacttctttcttgccgacgacattgacttccagcaaagaacgtctaagagatgtagcagaaactatcggacaagtgaaagattctgttaccggtgcgaaaatccaagggatttattttgaaggacctttctttactgaagaacacaaaggcgctcaaaatccaatctattttggtgatccagacatcgatacattccacgaatggcaggaagcttctggtgggattatcaaaaaaattgccttagctcctgaacgtaaaggcgttaccgattttgtgtctcaagtgacagaagaaggtgttgtggttgccttaggtcatagtaatgggactttacaggaagctgaagctgctgttgaagcaggagccagtgtttttgttcatgcctataacggaatgagaggactaaatcaccgagaaccagggatggtaggagcattgctatcattaaaagaagtattctctgaattgatctgtgatggacatcatgttcatccgcaagcagctgagatcttgatggaaaaagccgggcatgaccatgttgctttgatcaccgactgtatgatggcaggaggtatgccggatggagattatattcttggagaattccctgttgtcgtaaaagatggaacagctcgtctaaaagaaggaaatttggccggaagtattttgaaattaaaagaagccatcaaaaatgttgttgagtgggagattgctaccccgcaagaagcaatcatgatggcaagtctagtgccagcaatcagttgtaaaatcgatgacaaatgcggcatgatcaagaaaggtcgagcagctgactttatcgtgttggaccctcaaatgaatctgcaagcgacatttttagatggtgtttgccggtacgaagcttaagcagaaaaaagacacagatcgccaattggtgatctgtgcttttttgtaaaaacgtttaattgttttatcgattttcatcaatagctggaaggtagatcaaatttttcttgcccaacaaaagaaaacagcaaaaacgccttcctcacaagctgtcttgatacgtaaaaagctaagtagtgagagggcgtttatttttgttcttgctgcttggagatttcttcttgaacatcttccagcatagttttcaattccgtttctctttccttcaatacaaccaagtcttctttgatttctgcttgtttttctttttcgggaggcctcaagacaaaattgatgaagatcgcaatcagcgtaccaataaaagtgtctaacacgcgatctaatgcaaaaataaaagactctccttgtggaacactaagagtgatcaataacatcgtagcaatcccagaaataataccggaattattattgatcccatccgaaagaacgataatgaaggccactaaagcggggagtaccaataactcgatcaaaaaatcattgtggaaatactgtttcatgaagaagtagatgatggcagtagccccaccgatcgaatttcctaaaactcgtgatttcccaaaagaaagggtcgttgttaaatcttgacgtagtgagaagacagcggaaagggcagcgatcaaaggctgtccgcgattcaaaaatcgaaacagcaagatacacaacatgacagcaattgcggtttttatcgttcgcatccctagacgaaagcggccaaattgcatgatcgatttcctccttttctttaatcataaccaaaataaccgataaattctagtgaaatccttttttgtttagtatactttgaaaggaggtgcagaatgaaaattggaatgagaacagtcaagacagcgattgcttcgggtttatcgatggcagtggctcaagcgattgggttattatatgcgccagccgcagggatcattgcgattttgagcgtaggcaacacaaagaaaacatcgctttatacgggcattggacgcttgatctcactggcactggcgacaattctggcattttgcagtttttcgcttctgggatataatcctttagggtttgtgctctttttgtttttgttcatcccaatggctgtccgtttttcattgacagatggcatcgtggtcaattcagtcttagtaacgcactatttactggaagaatcctttgcttggcgcttgatcgtcaatgaattcttgctcatgattctcggagttggctttgcattagtatttaatctttatatgccagatggagaaaaagaactgaaagaattgcagcaagaaacagaaaagacgtttaaaagacttttaaaagatatgtctgaacacttaaatcaaccttctcgattgaccttgcaagggcaatgtcaatcattattggcaaagattcgacaaggacaagaaaaagcacaggtccatcaagaaaaccaatggagccaaaagaatagttactatgaagcgtattttgcgatgcggcgtgcgcaagttcgtttgttgacagaaatgattggtctcttgcgatccatttgggtagaagaagtttatacagagaaatttcgtgccttgctgctgtataccgcagaaacatttgatgaagctaacgacggcgaagaccttttgctaaggatcgaagagttgtatcaagattatcgacaaaaaccgctgcctagaaatcgcgaggagtttgaaaatcgcgcgcaattgtttcaatttttgcagtcgtttaaacgttttattgaaatcaaagccgaatttgctgaacgggatcattaagaaaaggaaagaatacgactgcccagcgaatcaaatcgctgggcagtcaattgttttattttgtttgcttccaaaattgttgcatctggtctaagacggcaatgacgtcacttgttagatggatcgatcctttagaagttccttcaatagttttaatcatattggcgatttcgtaatttagtgcttgggtcgtatcgcctgtttcaataaactcattggagccatcacgatagtgaatggttgctttatcagctcgcggatattcttcgactgtgatatagccttcttcaaaagcaacgattcctgtttttggcattttagcttggaaagttaggatcacactggccatttcatcagctgggttacgcaaaatcgtcacggattgttcgtcaacgccggtttcaaaaggcttcatgctgctgaattctacctttggtgactcactcatgaaaaagcgggcaaaagagacggcataagtaccaatgtcaagcagtgcaccgccgcctaaatcaggattgaaaaaacgattttgaggatcaggatccttgtaactgccaaaaggtgcttgaatcatttttaattttcctagtttgccagaggctacgatttcttttagacggtgataaagcggcatgttgtagatggtcatcgcctcttctaaaaccaatcctttttctttggctaaggccagttcttcagcaagttcatcgccacttgtagtgatcgctttttcgcaaagaacgtgtttccctgctgccagtgctgccatgatgtagtgatggtggatatcatttggtaccgcaatatagacgatatcgatcgatggatcagccaacattgcttcagcagattcataagcctgaggaatcgagaaacgttccgcaaatgcttggacttttgaataacggcgggcacagacaccgtacaattcgctagcatcgcttgcaaatccagcggcaaattgtgtggcgatgtctccaaggccaattatgccccaacgatattttttcattttctatcagctccttcgtttttagtataacaaaacttagtgaatcttaaaaatattgcaaagccaaagttaaaagttccatttatgtccagctttcagtaaaatagatacaggagggatgtatgatgcataacgtgtctattgcaattattttaagtacagttattgaacaatattctacggaagctcgtttctatgaaacgcagcttggaatcgatcgagaacaatgggaggcctggaaaaatgggacagcgagtttgacacctgctgaaaatcagaaaatcaaattgctgttctctgattatgaatggatgctgattcaaaaaattgttcgtcaaacggtgatctatcctgaaaagagaacaagtgcggtagctgaattcaagaaaatgaagacacagattgcacgcacgtggctttcaaatgatttggcaaaagtggaattattaacacaatctgaagaaagtactcaataccttgatttaagagtcagtattacgtatgatgaatggggctatgacgacattttgaacttccgtctgcctgcttttgtccaacaacaaatcaagaatgagaaaattgagttgttggcatgggtcaaagagaatttagaagaaacatataattaaaggtagggtttttttgaaaaaatatttaggtatcttagctgctgctggctttctattaattagtttggtagctagtctgcagcaggaacattcagcgagcagcgaaacaatcgcaagtagtcagacagtggcgcctagcagtgaaaaagaacaagcaagagtctctcagaagagtaaagattttcccaaagtatctttagatgattgggcgcttgttttagtgggccccctgaataaaggaactgaaatcgatacggggggattagcaaaattaaccaatggctatctcgtggacaaacgaatcgtttctgactatgaaaaattaaaagctgccgcagaaaaagctggtcatcctttagtgatgatctccgcctttcgctccatcgcctcgcaaaaggctgtttttgatcagaatgtcacgatgctgatgagtcaaggacaaaacaaagagaaggcaatcgaaacaaccaaacgaacgatgacagaaccaggttacagtgaacaccatacgggtttagccgtagacgtagttgatcgacaatggtatgattcttatccagaaaccgtattggaccaccgatttggtgagacagatggcggcaagtggctgcaagcgcatgcccgggaatacggctttatcattcgttacccagaaggaaagcaggccattactcagatcgattatgaaccttggcatttacgctatgttggtgtagaaactgctacatatattgaaaaacatcaactgactctggaagaatttctagagcaagtaaaagaacaggaggaagaaaatgagtaaacgacgcaaaacaacgaagactcgactgccgtttgtctttttaggtatcctcctgattgggcttgcttttattttttcaatgaacagtttagccgatcccttgccgaaacaagaggatagtgaagaaatgactcagcaagaatttattgatcgcattgcacctcatgcacaggaattgcaaaagggttacggtattttaccgagcattattttagggcaagccatcttggagtctgattggggcaaaagtacactagctagtgaatacaataatctttttggaatcaaagcatttggacatagtaaaaaagtgacattagatacccaagagttttataatgagcagtgggtaacgatccaaggcgattttcgagtctatgattcgtgggaagagtccatggatgaccacacgatgctctttgtcaatggtgtagactggaatccagcgctctatgtaaatgttttgtcggcaacagactacaaaacagctgccaaagcattgcaagaagctggttatgccacagatccggattatgcagagaaaatcattcgtgtaattgaaacctatcatttaaatcaatacgaccaatagacggaaagaagtgggtgcccatggaagaaaaatacatgccaaagatcacaacggaactgcgaaaagatatcgtgaaagttcctaaagttatcagacaagcaagcgggattcaaatttttggcaaacagatccgctcgatcatttttactacagatattgcaatcatccgcaataccaatgcagatgcggtgattgccgtctatccctttaccccgcaccctgcgattaccaaagcgattatcgaggcagctgatattcccgtattttcgggggtcggaggaggtttgactcaaggatttcgttcttcttatatgagcatgtttgcagaagcgcaaggttccattggtgtggtgctaaatggtccgacaccactgaaaactgtggagcaggtctgtaaggtcattgatattcctgtgatcagtaccgtaactagtaaatataccaaaattgatgaaaaattgaagttaggtgtcaaagtgatcaatatcagtgctgggaaaaaaaccgctgagactgttcgttattttcgcgagcggtatcctgaattgccaatcatcgctactggaggccctacagatgaaagtattttagaaacgatcgaagcaggcgccaatgcaatcacctatacaccaccttccaatggagagttattcagcaaaaaaatgcagcactatcgggaaatggaaaaacctgattagtgagcgttgagaaataaaatgagaacattcttattttggaagagttttctaaacttgcctttttaatcaatcttcggcataatcgaacctatcattcataaaatttaacttgtatatcgtcgtaataaggtcgacagtctctacccgataccgtaaatatcggactataagtaaaaaaagtgccattgatgcaccttttttgctttagcaaaaaaggtgtttttttgttgataggcctaaatggaaaggaaagaggtataggatgaaaaagttgatcgaacggatcgaaaaagacggaaatgttttaggtgatggcgttctgaaagttgatagttttttaacgcaccaagtggatccggaattaatgcaggaaatcggcacgatatttgccaaacgatttcaagcagagcagattactaaagtagtgactatcgaagcttcagggattgcaccagctttatttacggcacaaacattaggtgtgccaatgatttttgcccgtaaagccaaaagtctgacaatggacgaagaattattgacagcctcggtttattcctttaccaagcaagtcacgagtcaagtatcgatttctcggaaatttttgtctgcggaagacaatgtattgatcatcgatgactttttagcaaatggccaagcagcaaaaggattgatcgaattatgccagcaagccggtgcaacggttgctggtatcggaatcgtcattgaaaaatccttccaatctggacgagcattgcttgaagaaatgtcgattcctgttgtttctctcgcgcggatcgcttccttatccgagggtaaagcaactttcttggagggtgacgcttaatgaacgaacaaaatggacgctctgctgtcttagggttgcagcacttgctcgcgatgtatgcgggtgctgtcgcagtaccactattgattggaaccgggttaggatttaatgaagcccaaatgacttatttgatttccattgatatttttatgtgcggggtagcaacattgctgcaattgaccgtcacccgtttcttcgggatcggattgccggttgtcttgggctgtgccatccaagctgtttcaccattgattttgatcggaactaagtcagggatcggtgccatttatggagccattattgcttctggtatttttgttgttttgatctccggtgtcttctcaaaaatcaaagtcttgtttccgccattggttacgggaactgtcattacagtgattggtttgacgttgatccccgttgccattaccaaaatcggtggtggggatgctgccgcagcttcctttggcgcaccagacaatttactcttaggttttgtcacgattgcattaattattggtattcagatttttgccaaaggatttcttcgttcgattgctgttttgatcggtttgatcggcggaactttgctagcaactgtcttagggttagttgatttatccgcgatttctcacgcgcctgtctttcatttgccgcagccgttttactttgggttaccaacctttgatatttggtcgattttattgatgatcattatttcaatcgttagtatggtggagtctacgggggtctattttgcactgggagatattacaggacaacctgtttcatcagaatcattgaaaaaaggttatcgggctgaagggttagcagtgattctgggcggaatcttcaacacattcccttatacgggcttctcacaaaatgtagggctcgtacagttatctggtatcaaaacccgtaaaccgatttatttctctgcggtctttttgattatattaggtttgtttccgaaagttggtgctttggcgcaaatcattcctgaagctgtattgggtggcgggatgttagtcatgttcggcatggtggctgtccaagggatgagaatgttgtcgaaagtcgactattcaaatgacaaaaatttgctgattatcgctgtttcactgggattcggcttaggtttcaacattatgccaactttatttagccgcttacctgaaaccttgcaaatgtttactggtaacggaattgttatgagcagcatgactgcgattatcttgaatcttttattcaatggcttaccaaaaaaagaagcggtcgaatcaggagaatttaacgaagtttgatttacgaaagcattctggtcaacaggatgctttttttgttttagagagaagaaatgatcttttgttaaaagacgaacaatatatctcgtattttttctatagttcgatttttttttgactttatggatgtcacttgctagtatttaagtgaataatcgaagggagttgtcttatggaacaagtagcagtcattatgggcagtacgtcagattgggagacgatgaaacacagttgtgagattttagaggagcttgggattccctatatcaaaaaggttgtttcggctcatcggacaccggacttgatgttttcctttgccgaaaatgcaagagaaaaagggctgaaagtaatcattgctggtgctggcggtgccgctcatctgccaggtatggtcgctgcaaaaacaacgttacccgtgattggcgtacctgttcaatcacgaacattaaatggattggattcgttactttccatcgtacagatgccgggaggcgttcctgtggcaacgacagcgattggaaaagctggtgcaatcaacgcgggactacttgcagctcagatgctttccatgtatgatttaggaatagcggaaaagttggatcaacgaaaaaagacgttgaaagaaaaagtagtggaaagtagtgatcaacttgattaaacctttgatgcccaatgcgacgatcggaatcgttggcggcggacaattggggcgtatgatggcaatgagtgccaaaaaaatgggtttccgtgtcggcgtgctggatccaacagccaattgtccgacagcacaagtagctgactggcatattgttgctgcttatgacgatgtctttgcactggaagaaatggcgcggcgttctgatgtgattacttatgaatttgagaatgtcagcgtagaggctttgaattcgattttgccctatgcaaatattccccagggaactgatctattggcaatcacccaagatcgcttgttagaaaaatctttcttagaagccaataatattgttattgcaccttatgcgacaatcatcagtcctaccgatattcaagatgccatcgagagtatcggctatccttgtgtattgaaaacgactcgaggaggctatgatggcaaagggcaatatgttttatacagcacagctgatttagcgccttcgatgaatcttttgcgggaaggaacttgtgaattagaagcatggatcccttacgaaaaagaactctcgatcatggtggcagggaatggtcgtgaaatcaccactttcccagtggttgaaaatatccaccgcaacaatatcttgcatcaaacgattgcacctgctcgaatcgatgctgaggtagcggaggaagcagaacggatcgcgcgtgtgattgcacaagcccttgatttacgcggtgttttagcgatcgagctgttcttaacgaaaagcggcggactatatgtgaatgagttggcaccacgcccacataattcaggtcattactcgattgaagcttgttctatgagtcagtttgatgcccatgtacgtgggatctgcggttggccgcttgcagaggttaaactgttgagtgatgcggtcatggtgaacatcttaggtgatgaactcattgaaacatatgacctgattgctcataagccagattggcaattccattattatggcaaagaagaagcaaagagcggtcggaaaatgggacacattacgttgttgaccgaagacattactgcttcattggaagaaatctatcaaacgaatatttgggattaaaggagagtaacgcatgttagaacgttatacaagacctgagatgggcaaaatttggacagatcaaaatcgataccaagcatggctagaagtcgaaatcttagctgatgaggcgtgggccgagcttggtgagattcccaaagaagatgtggaaaaaattagagagaaggcaactttcgatatcgaccgtatcttagagattgaagcacagacgcgtcatgatgtggtcgcattcacccgggctgtctctgaatcgcttggtgacgaaagtaagtgggtccactatgggctgacttctactgatgtggtagatacggcttatggttacttgatgaagcaagcgaatgacttaatccgtaaagatctagaaacattcacagctatcattggtgaaaaagcaaaagaacacaaatatactgtcatgatgggacggacccatggggtgcatgccgaaccgacgacatttgggttgaagcttgccttgtggtattctgaaatgaaacgcaatattgaacgtttcgaacgagcggcggctggagttgaagctgggaaaatcagcggcgcagtaggaacatttgccaacattccgccatttgttgaagaatatgtatgtaacaagttggggattcgtcctcaagaaatctctacgcaagtgttgccgcgagatctccatgcagaatattttgcttccatggcactgattgcaacaagcattgaaaaatttgcgacagaaatccgtggattgcaaaaatcagaaacaagagaagttgaagagttttttgctaaagggcaaaaagggtcttccgcaatgccgcacaaacgcaatcctattggttcagaaaatatggcgggattagcacgagtgatccgcggtcatatggtgacggcgtatgaaaatgtttctctttggcatgaacgtgatatctctcactcttctgcagaacggattattatcccggatacaacgattttgattaattatatgctcaatcgttttggaacgatcgtcaaaaatctgactgttttcccagaaaatatgaaacgtaatatgaatgcgacttttggcttgatctatagtcaacgtgttatgttgaaattgatcgatcatggcatgactcgagaacaggcatatgatcttgttcagccgaagacggcacaagcttgggacgaacaacgggattttcgaccattgttagaagctgaccaaaccattatgtctacgttaagtgaaaaagacttggatgatgcatttgattatcatcatcatttaaagcaagtggatacgatttttgcgcgcgtaggtttaggtgaatagggaataaaccccgaaaaaaacaaaaggcacgctgcttcaataagcagcgtgccttttggggtagttttattatttagttatagttttcggaaagataagacaaaagatctggggctaatgctgtagcagaagagttttcttgccgatcttctagcatggacaccatcaaatacttttgattctgggcatggaaagcaaataagaagctattttcctgtcctttctcatcttgtttctccttgatctcagctgttccagttttggcagcaagaggcaaaccgagagctgctagggaatgggctgtcccattctcatcggtaacgacagctttcaaatcctcattgatcagtgaaatcgtctctggtgaaatcaactcttttttcgtctttgtttctgcacccatcactaatcgtggataaaccagagatccttgattggcgaaaacagagtacatcgctgcttgttgaattggattgatcaacaattctccctggccatagccagtgtctgccagcaaaatctcagaattgaaggatttgtcattgctgatttgtgcagggttcatggcaatcggcaagtccaattcttcaccgaaaataaatttctccaaaccagcacggaatttgtcttcacccatcgccaatgtttgttgagccatatagatattatccgaatagacgagagcgttacgcaagttaacggatgcgacatcgctgacccgagtcacgaagtaatctccccaagagctatctttttgccatttcaatccgttgattgaaaggacggtttctggattgatcgttccattgtctaaaccgatggctgctgtgattgttttaaaggttgaaccgggagcataaccagttgcaaagcggctgataaatggtagatctttgttgttatggtaagcatcatagtcctcttgtgaaattccgttggtcattttattgggatcaaaacttggagaactagctagaacgagcagatcccctgtggttggttcagtgaccacggtagaaccagcctgattcttaagggaatcaaaagcgattttctgtgctttggcatcgatcgtgagttgaatcgttttgccgtcagtttttttcgtttcgatcaatgcttttcgctctgtgcctttttcatcggtgatcgctatcttaccaccgttttttcctcgaagttctttgtcaaaagctgcctcgagaccagagcggccaatttttccattgctggctaatgtatcatctttttcaacatcttcagccgtaatgtctcctacataaccaatcaattgtgcagcggcttcacctaatggataggttctgcccgcggtttcttgaatgcttgcaccggttgggagatcagctgtgggttccacgattttcaaaggaacaaagtaatcgtcttgcacccaagattgatccaatgcttgctggatcgctttctcagtcaggtcaaactgcttagcgatcgctttgattcttgactctttatcctctccatctcctaattgtccgggaatcaccccaagctggtacaaggtgccattagcagccagtggtgttttgttgcgatccactatttcacctcgaacagcctcatcaacagaaatacttactttatcttgtccagccatgtcagggaaaatcaggtttggagcccaatcgatttttggctgatctttttcaaatttgatggttccggaataattcagatctttgatttcccccaagctagtagtgagagataactgataggtaaactgataatctgcatctttgacatcatcgcttaaagtgattttggaacccttgatgttggcagcatcaattccgctgaaaattgtttgatatttttctgctacttgatcattggtataaccatttctttctgcgctatcagaaagaatcaaggatggtaatttgtcgaatttgttttttgaaaggttctcaatgaatgagtggacgactttctctgcctgattttgtcgttgctgtttgtcataatagcgatagccgaaaaagccacctactacaagcaataagagcagaggaagaacaatcagtaaagtcttccgtttttttggtggttgattttgagagcggcgattttgtcgttccatttttcttaattcccttcttggttaagtatcggtaactcttcgcgattccgataaagcggcagcagcaagcgataatctgctaacagttgctccatagtgagcgtagaaatctgatctttgagatagactttgccaatctgtaattcgcttttttttacagtagtcagccgctctagagcagcgggccattctcggatcggctgatagccatattgcgtatgatccagagagaggacaaaatcttgaggtagagtttcaaacagtgccggtttctctgaccagcagcgagcgatttgctgttggtttttcggctgatcaatcacacttaaccagacaaaagcatactcacgagtaataccgatctggaagtgggcatccatcttataacctcgcttgtttggtccaaaagctgcccaagtttcttctggaggatagacacttcgccgtcggtgctgtgcgatatgcagataaaaaggagtgtctagcttttctgtgaaaaaagggcagactttttcaccaatttgctgaaaaatcggttggatctctttacgaatttcctgcattcgttcttccaagctcgaagcttggaagacgtgaaagcttttattagtaaataacatagagtagaattcctttcttgtattctaagagatagtatagcaaaaaaacacccttaaaatcgcaatttaggcgttttttaagagtgagtttaactatttataaaattaggttttaaaggagtgaaagtcttttcctcattgagtaagtttagcaagacatccaaaaaggcagtttgcatttcttccatattgaaataaatacggaaacaataggtgtgtttaaagaaagtctgctgatggatttgatggataatcaattcttcgtttaatccgtttttatattggagtacccgttttcgatgttcggaataatgaggccgggcatgttttttgaatggactgaataaataaaaagatgtcatttgatttgcggtcaacacttgttgaacggcaagtagttcattatgtagctgttttctgtcggtgtccgataaatgagcgataaatcgttgcgcttgattttccagtgaccacatgaatcaattcctccttggagataccaatattcacaaaatcaatataacatgaaaaaaaataaatgtaaacgctttatagtgtgtgaacaagtcggaaatctgcagaacaaaaaatgattttaagttaaacacgaacgtttaaagaaaaattagttgttaatgtacattattttgttgacccttattctttgcgttgttagaatagaaaacaacaagaagagactaaaaatctatgtgaaaaaactaacttttgtgaggtgtccggtggtgcaagaacaattgatttacgaagggaaagcaaagaaactcttcaagactagcaaagatgaagagctccgtgtggagtatctcgatcaggctaccgcgttgaatggattgaagaaagatgcagtttcaggaaaaggagcactgaataatcagattaccagtcttatttttcaagaattagaaaagcagggtattccaagtcattttatcaaaatattgtctaaacacgaacaattagtttgtgaagttgaaatgatcccgttggaaatcgtcgtccgtaatacggctgccggcagcttttctaagcgcctgggaattgctgaaggggagcagctgccttttccgattattgaattttattacaaagaagaccgcttagacgatcctttcatcaatgaagatcacattcgttatttgggaatcgccacccctgaggaagttgctcaaatcaaaatgcttgctcgacaaatcaacaccgcattgtgccaactctttgagaaaattaagatccacttggtcgactttaaaattgaagtcggaaaaagtgatgggaaaattcttttagcggatgagatttcgccggatacttgtcgcttatgggatctgacaacgaaagaacatttggataaagatgtctatcgtcgtgaaatcggggatctgattcctgtttatcaagaagtattaaatcgcttagaaaaggagtatagttcatgtatttagtcaaagtttatgtcacttataaagagtcggtcttggatcctcaaggagaagcagtcaaaggagcggttcatcgtttggggtatcaaaatgtctctgaaatacgtattgggaaatattttgagatcaaagttacagacagcaacaaagaatcagtagcggcagaaattgaagaagtttgtgacaagttactggcaaatgtcaatatggagacttatcgttatgaaatcattgagatggaggacaaggaacaatgaaatttgcagtaatcgtttttcctggttcgaattgtgatgtcgatttaatgtatgccatcaaagatgtgatgggcgaagaagccgaatatgtgtggcatgacgagacctcgttagctggctttgatggtgtattgcttccaggaggtttctcctacggggattaccttcgctgcggagccatcgcacgtttctcgaatattatggcagaagtcattcgttttgcagaagaaggaaaaccggtctttggtacgtgcaatggcttccagatcttgacagaagctggcttgctgccaggggttttacgcagaaatgaatcgctgcactttatttgcaagccggtacagttgcaagtcaataaccagacgccttttacctctgaataccagcaagatgaacggatcacgatccctgtcgctcatggagaaggaaattactattgcgacgatcaaacctaccaggaactggaagccaataaccagattgtcttccgttatgtggataacgttaacgggagtttacatggtattgccggcatttgcaacaaggcaggcaatgttttagggatgatgccccatcctgagcgggcaatggaagagttgcttggctcaaaggatggcaagaagttctttgcgtctttattgaaaaatttcgggaaggtgccagtacatgaataaagcaatcatagcagagccaacaccacaggaaatcaaagaaaccaagctttatcaacaatgggggctcactgatgaagaataccaaatgatttcagaagaaatattaggtcgactacctaattatacagaaacgggtctcttttcagtaatgtggagcgaacattgttcctataaaaattccaagccggtcttgcgcaaatttccaaccgaaggcccgcaagttttacaagggccaggcgaaggagcgggaatcgtcgatattggtgatggccaagcagttgtctttaaagcggaaagtcataaccatccttcggccgtggagccttatgaaggcgccgcaaccggcgtcggtgggattattcgtgatattttcagtatgggggcgcggcccatcgcgatcctagattcgttgcgttttggcgaattgacgaatgagcggaccaaataccttttagaagaagtcgtggcaggaatcagcggctatggaaattgtatcggaatccctacagtcggtggtgaagttgccttcgatgcctgttacgaagggaatccattggtcaatgcgatgtgtgtcggtttgatcgaccacaaagatattcaaaaaggacaggccaaaggcgttggtaacataatcatgtatgtgggagcaaaaacaggtagagacgggatccatggtgcaacatttgcttccgaggagttcgtggagggagaagaacagcagcgctcggctgtccaagtaggagaccccttcatggaaaaattgttattagaagcttgtcttgagctgatccttgaacattcagacagtttgatcggtattcaggacatgggggcagccggtctcgtttcttccagttctgaaatggcttcaaaagctggttcaggattaaaactttatttagatgatgtaccgcaacgagaaactggtatgacaccttatgaaatgatgctatcagaatcccaggagcggatgctgatctgtgtgaaacaaggacatgaagcagaagttgaagcgttgtttcaaaaatacggattggaagcggtagtgattggtgaagtaaccgatgatggtgcgtatcgcttgtaccatcagggaaaagaagttgccaatttacctgttgatgctttggcagaagatgcgccaacttatcataaagaaaaagcagaacctgctagaatccaagcatttcgtcaacagcctgattttgaaccagtcattgatgatgcaacagcagtctttttacaattgttgcagcaacccacgattgcttcaaaaaaatcgatttttgaaacctatgattctcaagtgagaaccaataccgttgttggcccaggaagtgacgctgcagtcctgcggatcaaagggaccaacaaagctttagctatgaccacggactgtaatgctcgctacttgtaccttgatcctgaacgaggtggacagattgctgtagcagaagcagctcgcaatattgttgcttctgggggacgaccactagcgatcacagactgtctcaactatggctcgccggataaaccagaaggcttttgggagttatggacatcggcagaagggattgccaaagcttgtgaaattctagaaactcctgttatttcaggtaatgtttcgctgtataatgaaaccaacgggcaggcaatctatccaacaccagtgattggtatggtagggctgattgaaaaggtcgaacatatcaccacacaacatttccagacaccggaggatttgatttatttgattggagaaacgaaggccgactttaacggcagtgaactccaaaaattacaaaatgggtcgatcaatggccgtttgatggcatttgatctattagaagaaaaacagaatcaggcaatcgtcttatctgcgatccaggctggacttgtaaaaagtgcccatgactgtgcagaaggcggattagctgttgtattagctgaatctgcgtttaagaagaatgtcggtatatctgttcaactagatttgccgcaatcttggcttttttcagaaacacaaacgcgatttgtgctgtccattgctccagaaaatcaaaccgcttttgaagctttggcaggtgatagcgcttgtctcatcggaaaagttacagcagaaccgcaactaaaaatccaaggtagcgatggaatgatcgtagtggaaacagccttagcacgtaagaaatgggaggaagcaattccatgtctattgaagtaaaaagcttgaatgaagaatgcggggtttttggtgtctggggtcacccagatgctgcccgagttacttattttggcttgcacagtttacagcatcggggacaagaaggcgctgggatcgtcgcaaatcagcaaggcaagcttgtcggtcatcgagatcttggcttattggcagaagttttttccgatgaacgacttcttcaacgattgacaggtgaagcagcaatcggacatgttcgctatgctactgcaggcaatggcagcgtcgataatatccaaccttttctttttaagttttttgatcagcagattgggttggcgcacaacgggaacttaaccaatgccaagagtttgcggaaatcacttgagtctgaaggagccatttttcattcaaattcagataccgaaattttgatgcatctgattcgccgcagtggtcaagcgaatttgctggatcgcatcaaagaagcgctgaatcaagtgaaaggtggatttgcctatcttttgctgacagaagatgcgatgatcgctgctcttgatccaaatggatttcggccactctcgttaggaaaaatggtcaatggtgcttatgtgattgcttcagagacttgtgctttagaagtgatcggagctgaatttgttcgagatatctgtcctggggaagttgtcattgtggatcaagcgggctaccgtgttgaaacatatacggaagaagtccaaccagcgatttgctcaatggaattcatttattttgcacgaccagattcgaatattgccggcgtcaatgtccatactgcacgaaaaaatatgggacgtaatcttgcccaagaagcaccgatcgaagcagatatggtgatcggtgtaccgaactcatccttatcggccgccagcgggtttgcagaagaatctggcattccttacgaattaggattagtcaaaaatcaatacattgcacgaacatttatccagcccactcaagaattacgggaacaaggcgttcggatgaagctttctgccgtccgcggtgtggttgaaggaaaaaaagtgatcatggtggatgactcgatcgttcgcggcactactagccgacgaatcgttcaattgttaaaagaagccggtgccaaagaagttcacgttcggattgcttcaccgccattaagatatccttgtttttacggaatcgatattcagacgcggaaagaactgatcgctgctcggcaaagtgtcgaagaaattcgccaaacgatcggtgccgattcgttggcttttctcagtgagactggcttgatcgaagcaatcgggttagatttagacgccccctattctggattgtgcatggcctatttcaatggtgattatcctacaccgctttatgattatgaagaaagctatttagcgtcgctcgaataaatggtacaggaggaactcaaagtggcaaatgcttatgcaaaggctggtgttgatgtgaacgccgggtatgaagtcgttgatcgaatcaaaaaacatgtcaaaagaacagaacggttaggtgtaatgggtgccatcggtggctttggcggctgttttgatttgtcaaactatccgctgaaagaaccagtgctggtatccggtactgatggtgtaggaacgaaattattagtagcgatccaacaaaatcaacaccaaacgattggaatcgattgtgttgcgatgtgtgtcaatgatattgtcgctcaaggagcagaaccgatctattttttggattatgtcgcagtgggcaagaatgatcccgaaaaaatcgaacaaattatcgccggggttgcagagggctgcgttcagtcgggagcggctctgataggcggtgaaacagcagaaatgccagggatgtactcggaagaggactatgacttggctggttttgcggtgggaattgttgaaaaatctcgtctgatcacgggagcatcgattgaaccgggacattttctgatcgggctgcctgcttctggtatccattcaaacgggtattcattggttcgcaagatcttttttgaacagcaaggttttcaaatggcagagaagttgccggaattaggcggaaaaactctcggagaagaattgttaacaccaacgagaatctacgtatccgctgtactgccgttacttgaaaaacaattaattgacggtatctcgcatatcacgggtggcggctttatcgagaatattccccggatgttgccgccgcagacaacagcagaaatcacactgggaacgtggccgcaactgccgatttttgaggctctagcttcttatggaaaaatcccggcccatgaaatgtatgagatcttcaatatggggattgggatggttcttgctgttgcaccagagaagaaagaacaagtgctagctttgttaaacgagcagaatgaagcagcttacgttattggtaaagtaacggaggctcaagaacatgcggttcttttacaaggagatccgctatgaggatcgctgtttttgcatcaggaaacggcagtaattttaccgcaattgccgatgcgattagagaagaagaactcaaaggggctacattagcgctgctgttctcagataatcccgccgcatttgtcttggaacgtgctaaagacgcgggggtagcgacattgcagttatccccgcagaaatttccttcgaaagcagcgttcgaagccgcactgttgaacgagttggcggaacattcgattgagctgatcgttttggcaggctatatgcggatcgttggacctacgttgctagccgcttttcccaatagaatcatcaatctgcatccctcattgctgcctagtttttctggaaaatccggtattgccgatgcctttcattatggagtgaaggtgactgggatcaccattcattacgttgacagtggtatcgatacggggccgatcattgcgcaagaagtggtacgtatcgaatcggaagatacattagaaagcttagaagcaaagatccatcatttagagcatcgagtctatccagcggtcatagctgaaatcattcataaaggagaccatcaatcgtgaaaaaaagagcgttgatcagtgtgtcagataaacaagagatcgtatcttttgccaaaaatttagtacaaaacggctacgaaatcatttcgacaggagggacaaaatctgctttggaagcggctggtcttgaaccgattgcgatagaaacggttacaggatttcccgaaatgatggacggacgtgtcaaaacattgcatccaaagatccacggtggtttgctgggtcgccgggacctgcctgaacatttagcagcaatggaaaaacatgacattgcgccgatcgatctggttgttgtcaacctttatccttttaaggaaacgattgcccaagcggatgtgacagaagagcaagccattgagaatatcgatatcggtggaccaagcatgctgcgctccgctgcaaaaaactttgctgcagtgacagtgatcgttgatcctaaagattatcccctcattctagatgaattgacggaaaccggtcagacgcagcttgccacgcgcaaacgcttagcggctaaagtatttcgccatacagcagcttatgacgccttgatcgccgattatttgacaaaagcagttgaagagtctgaaccggagaagttgacactgacgtatgaattgaaacaaacgttgcgctacggagaaaatagccatcaaactgctgctttttatcaagatgcattgccagttccttattcgatcgctagtgcaaaacaacttcacggcaaagaattgtcctacaacaacatcaaagatgcggatgccgctttgcgaatcgcaaaagaatttacggaacccactgcagtcgctcttaaacatatgaatccttgtggtatcggaacagcgacgacgatttttgacgcttttgaacgggcatacgaagcagatccagtttcgatttttggaggaatcatcgtattgaatcgccccgttgatgaagcaacagctgctgcattgcatcaaatatttcttgagatcgtgattgcgcctgcttttgaaccagcggcgctggatattttgacgaagaagaaaaacattcgcttgatgacgttagattttgtagcaaatcctgtcgaaacagaaatggtctctgtattaggtggtttattagttcaagaacaagatacattagcagaatctcctaaggattggacggtcgtaacgaaacgtcagcctagcaagaatgagttggaagcaatggcttttgcttggaaagcggtaaaacatgtcaaatcaaatgccatcgttttagcgaaccaatatcaaacagttggaattggtgctggccaaatgaatcgcgtgggttctgtaaaaatcgccattgaacaagctgctgaagctggaaaattaacggatgcagttttagctagcgatgcgttcttcccaatggatgatagcgtggaatatgctgcaaaacggggaatcaaggcaatcattcaacctggaggcagtattaaagaccaagcgtctatcgaaatggcagatcaatacggagtagcgatgatctttactggcgttcggcattttagacattaaaagacattaaattcaggaggagcagatgaagcttttagttattggtagtggtggtagagaacatgcaatcgccaaaaaattactcgcagatccgatcgtagaaacagtctactgcgcgaaagggaatccgggcatggtcagcgatggcattcaggtagttgctatcccagaaacagaccatcaaagcttgatcgcgtttgcaaaagagatggccatcgattggacctttgtaggccctgaagttcctttgcttaatggcatcgttgatgatttccaagctgcaggattgaacatttttggcccaaataaagcagcggcgatgattgaaggttcgaaggaatttgccaaagaattgatggcaaaatatcagattccaaccgctgaataccagtcttttgtagatagtgaaaaagcgaaagcgtatatccaagaaaaaggtgccccaatcgtaatcaaagcagacggtttagctgctggaaaaggggtcgttgtcgcagcaacagtggatcaggcactggctgcggtagaagaaatgttggaagaacaaaaatttggtcaaagtggtgccaaagttgtgatcgaagattttctggaaggagaagagttttcgctgctggcttttgttcatgaagagcaagtttatcccatggtgattgcgcaagatcataaacgagcgtttgatggggatgaaggaccgaatactggtggaatgggagcttactctcctgttccgcaaattcctcagtcaatgatcgatcaagcaatcgagacggttttgatcccggctgctacaggaatgattgatcaaggaacaccctttacgggtattttatatgcggggctgattgccacagttgaaggacctaaagtgattgaattcaatgctcgttttggagatccagagacgcaagtcgttttgagtcggctaacgagtgggttagctcagattattgatgcattgctcaatggaagacagccggagattacttgggatcagcagttttctgttggtgtggtcgtggcggctgaagggtatccagaaacctatcaacagggaatgatcattccgcaaaaagcggctgaagatgttcaactgttttatgcaggggttgctgaaagagcaggagaattggtggcagcaggcgggcgagtatttttagcggaagggcaaggtgcttctttggaggaagcgcaaaagaaagtttaccaagcgctagcaaaaatgcctttgaacaagatgttttatcgaaaagatattggtgccaaagcattaaagtaaccgcaacttctctttggttccatcgtttaaacaaaagatcgctgatgagagaacagcgatctttttttcttaaaaagaggtagcgttttcaaacggatatgctaaaatagaagagcaaacagaggaggaaaaatacgtgaaaaaaattaaatttggttcaaccgatttagaaatttcaagtgtcattttgggattgatgcgaatcaataatgcaaaagatcctgtagctgtactgacgacagcaatcgagaatggtattactttctttgatcatgcagatatctatggcggtggcgaatgcgaaagtatttttgcagatgcccttgcacaaaccgaatataaaagggaagatcttttcattcaatcgaaatgtggtatcgtcccagggaaaatgttcgatttttcgaaagaacacattattaaatccgttgaaggcagtttgaaacgcttgaaaatggataatcttgacgcgttgctgttgcatcgcccggatacgttagtggagcccgaagaagtcgctgctgctttcgacgagctggaaaaagcgggaaaagttaagtattttggagtcagcaatcaaaatcctggtcaaatcgaattgttgaaaaaatatgtctctcaaccattgctggccaatcaattgcaatttggcatcatgcatactggaatgatcgatcgaggcatccatgtcaatatgacggatagcggcagtgtcgatcatgatggcggaattcttgagtattctcggctgaatgatatgacgatccaagcgtggtcgccataccaatatggattctttgaaggtgtcttcatcggaaatgagaaattcccagaactgaatgcaaaactggaagaattggctgagaagtatcaaacgactgcgacaggaatcgcatctgcttggattctacggcacccagcaaatatgcaggtgatcgcaggcacgatgacgccgcatcgtatcgaagagatcgctaaggcatctacgattgtgttgacacgccaagaatggtatgaagtatatttggcagctggcaatattttaccttaaaaaaagaagaaaccctttatttaatggaaactatctcaggaatgttcgtaaaagacgaacattcctgttgctctttaaaaaaaagattctaaaacacttgtatttatgagtgagctggtttaaattgttgtgggcattaaaaataggcgacagccatttgatgcttgcttcactcttatcaagatttggaggatatttttatgtttgacatgaaagtttttgattacgaagatatacaattaatccctaataaatgtatcgtgaatagccgttcagaatgtgatacgacggttactttaggcaaacattcatttaaaatgccggtcgttcctgcaaatatgcaaacgatcattgatgaatcaatcgcagaatttttagctgaaaatggctatttttatattatgcatcgctttgacgaagcagcccgcattccttttatcaaaaaaatgaaggaaaaaggcctgatctcttcgatcagtgtcggtgtcaaagactatgagtatacttttgtcgaaacattggctgctgaaggactggtgcctgattatattacgatcgatattgcccatggacattccaatgctgtcatcaatatgatccaacatatcaaaaaacatttaccagatgcttttgtgatcgcagggaatgttggcacacctgaagcggtccgagaattggaaaatgccggcgcggatgcaacgaaagtcgggatcggaccagggaaagtttgtatcactaaaatcaaaactggttttggaactggtgggtggcaattagctgcattacgctggtgtgcaaaagcagctcgcaagccgattatcgccgatgggggaatccgcacccatggagatatcgcaaaatctgttcgttttggggcaacgatggtcatgattggttcattgtttgctggacatgaagaatctcccggggaaacaaaagtcgaaaatggtgtcgttttaaaagaatactttggctctgcttctgaattccaaaaaggggaaaagaaaaacgtcgaggggaaaaaaatctggatcccttacaaaggttctttgaaagatactttggttgagatgcagcaagatctacaatcatcgatctcctatgccggtggcaaagacctcgaatcgattcgaaaagttgattatgtgatcgtgaaaaactcgattttcaatggcgatacaatttaagttgcttcggctgtagaattgacagtggcatgaataaaagttcgatccaaaagatttctttggtcttacagcaagcgatagcaaaacattcttatcacttgctgctgagggcaacaagtcttttggtttttttattttcagcgctgaccttctgctttttgtggaatcatctctatcgactatttggtttttcttaatctttcgttataatagaagaaatgatgaaaaaaaactaaaaaaatattctgagctaaaagcggatattcagttgactaagtgagtaagagcaataacaataaagtaaacatgcagaaagaagcaggtgagtgtttgactatcaaagtaatgtccgtttttgggacaagaccggaagccatcaagatggcgcctttggtaaaagaattagaggctgatcctcgatttcaatcaattgtcgtggtgacagcccaacatcgcgagatgttagatcaagtattagaggtttttgcgatcgaacctgattacgacttggatatcatgacattgggacagacgttgaccggcatcactacaaaagtcttgctggaattagaaccgattctccaccaagaaaaaccgtcaattgtgcttgttcatggtgacacaacaacggcatatgccgcagcaaccgcagctttttacgctcagattccgatcggtcatgttgaagctggtttgcggacgtggaataaacgatcaccctatccggaagaagccaaccggcaactcatcgatgtgctagcggatctttactttgctccaacgcttcaaagtaaagaaaatctacttgcggaaaatcatgatccagaagccatctttgtcactggcaataccgcgattgatgccatgcgctacactgtttctcaagactatcagcatcctacactaacagacagaaaacagcgaaagattttgttgacgatgcaccgcagagagaatttaggtcagccgatgaagaatgtttttcaggcattggctcgaatcgcaggcgagtttccagaagtctcagtcgtttttccgatgcataaaaatcccaaagttcgagaaattgcccaagaaactctgggtgctttagagaatgttacattgattgaacctttagatgtcatcgattttcacaattttgccaaccaaagcacattgattctaactgattccggcggtgtccaggaagaagccccttctctcggtgttcctgtattggtgttgcgggacacaactgaacgtccagaaggcattgcggcaggaacgttgaaattggtcggtacaggggaagaggatgtgtatcaagcaacgaagcagttgttgcaggatcacgctgcatataccgcaatggcgcatgctgaaaatccttatggtgatggtaaagcaagtcagcgaatcaaagaagtgttggctcaatattaccgtctgtccggaatggcagatccttcgatccaatgatccaaaaactgaaaatggaattgaaaaataacaaaagtattttcacataatggttgacctatataattagatagactatagtgaggatagaaataaataattgttaggtgaggctcctatatggacacaagctgctgccgcaaaagtatcgagagatgcttagttggtaggacaggtctaatcgtgaaggttaaacccaaagcagctgataacgtcaagttatctacgccctatagtgctaaagctctacaatgatcatgagttttttacgcatgcttattgggagcatgcgtttttttgtgttaatggtcactgatgcctttattttagctgatacatacagacctttatgaggtgctgcaagacaattgctgactgcctttatttttgaccaacacttctgcatgatccagagtttcttgcttgataaacagagaggaagatgaacatggaataccccagtccccagatgaacaataaaaagaatgctaggggtagcaaatgcaactcctagttataggaggaaaagaagatgttaaaaaaattatctaaagatcaagaattaaaattacttgcacaactttcggaaagagagttgctgatggaaatgcggacttcgtttaatggactatcaaaagaggatgcagcagaacgtctggaagaatatggaccaaaccaagtagatgcacaaaaaccaacacctgcttggctgatgtttttaagtgctttcaaagatccttttgtattagttttggctttgctgatggtcatttcttttttcacaggtgattatgaagcagtggtcgtgatgggaatcatgatcttagcaagtgttacgatcacattcgtgcaagaatatcgttcgcaaaaagcaagtttggctttaaaagaattaattgaaaatacatgttctgtcactcgagacggcgaaacgatcgagattccgatggatgaagtcgtaccaggagacatcgtgacattggcaaccggggatatgattccggcagatgctattttgatttggacaaaagatttatttatcaatcaatcttctctgaccggagaatctatgccggtggaaaaatttgtcgatgctgggatcaaagattctaaagaaacgatttccgcattagatatgcaagatttggttttcatgggaacggatgtccttagtggacaaggtaaagcaattattttaaaaaccggtcaaagtactttttttggtgatattgccaaaaatgcaacgtcaaaacgaggaaagactacttttgaggatggtttgacgaaagtcagtaaattgttgctgcgaatggtaatggttttgtttcccatcgtctttttgatcaatggattgacaaaaggagactggggagaagcccttttcttcgcaatcgctgtagctgttggcttgactccggaaatgttgccaatgatcgtcacaagtaatttggcaaaaggtgccatgtcgttagctaaagaaaaagtgatcgtcaaagaattgccttcgattcaaaacttgggcagtatggacgttttatgtacggataaaaccggcacgatcactgaagatcgcgtcgtattagtgcagcatctgaatccgtttggtaaagaagaccaacaagtgttggatatgacctatttgaattcctactatcaaacaggttggaaaaatttgatggatattgcggtattgaactacttcgaagatacagagcgccaagcaccgtatcaagaagtcatcaaagtggatgaaatcccctttgacttttcccgccggcgtttaacagtggttgtcaaagcagatggacaccaaatcatggtcacaaaaggtgctgctgaggaaatggagaaagtctgcaaatacgtggaagtcaacggacaagttctggaattgacagatgaattaagagaaaaacttcgtgaggtaaatcaccgcttgaacaaacagggcatgcgtgtcctaacagtagcaatcaagcgagatgctcacgcagaagccgtctacacagttgaagatgaacaagatatgatcatgatcggattcatgggctttttagacccagcgaaagagtccgcaaaaacagctattgcttcattacatggtcatggtgtcaacgtgaaagttttgactggtgacaatgcgatcgtggcgcaaaaggtgtgtaaagatgtggggatcgaagtgaacgactatcttctagggatagacgttgatcgtctctctgatgaagaattggctgaaaaagcagaagcggtcaatctatttgctaagttgaatcctatgcaaaagtcacgcatcattcagtcgctgcaagccgatggtcatactgtcggatttatgggggatggaatcaatgatgcgcctgcactgcgggctgctgatgtcggtatttctgtagatacggccgcggacattaccaaagacgcaagttcgatcattttattagaaaaaagcttgaatgtgttagataaaggcgtcattgaaggccgtaaagttttcacaaacatgatgaaatacatcaagatgacattgagttcaaactttgggaatgttttttcgattcttgtcgctagtgcattcttgcctttcttgccaatgctttctattcaattgctggtgcaaaatctagtctatgatatggcacagttgactattccttgggataatgtggatgtggaagaactagaaaaaccagtcaagtggcaagtcagaggcttattgaaattcaccgtaagcattggaccagtcagcagtatttttgatatcttgacattcttcgtgatgtggcatgtgttccaagcaaatgccattcaagaacaagcgctgttccaagccggctggttcatgatcggtcttgtgacgcaaacattagtcgtgcatatggtccggacgcgtaaactgccatttttccaaagtatcgcatcgccagcagtcttactgtcaagcgttcttgcgattttggtgggtttcggtattatcttgtcgccgctgcacacagtctttgattttgcagcgctaccatcttcttactggccatggtttgtcggcattattcttgcctacctggtaagcgtagaagtagctaagagaatctatatccattatacaaaagagtggatctgagaaaagaaacggatagtcataaaagattttaacttttatgctatctgtttcttttttattctattctgtattatttttttctcattatcaaaaaaaactaattttactaagtcggaacattcacaagggaaagtcctcgaggtgttacgtttctgtttagttaaaaggcgaagtctgtactattcttaaaagaaaaaaagaatttaataaggagcaaagcaagaaagcgattgcttaaatgtgattgttttcactaatcgtttcttaagagttggtctaatgggaatcgttttattaaaaaaaaataccttttcacttgtcttattctcgtttaaatgataatttataatagtaaatgatttttcgatgatacagattttatccctgttacattcgaaagtgaatttttatatcagagaggaaagtgtgtcaagatggcaaaaaaacaaaaagcacttgatttccaagcaattttggagcaagtcaatgcagattttccaacttatcaagcattagataaagacggaaaaatcgtaaatccagatttagtacctgatctaagtgacgacgaattagtcgagttgatgactcgcatggtatggtcccgtgtattagaccaacgctctactgcgttaaaccgtcaaggtcgtctaggtttcttcgcgccaacagctggtcaagaagcaagtcaattagcaagtcattttgcatttgaaaaagaagatgtgcttttaccgggttaccgtgatgtccctcaattgatccaacacggccttccattgaaagaagcgttcttatggtctcgcggacacgtagctggaaacctttatccagaagacttgcaagctttaccaccacaaatcattatcggtgcgcaatacgtgcaagctgctggtgtagctcttggtctgaaaaagcgcaacaagaaaaatgttgtcttcacttatacaggtgatggcggttcttcacaaggggacttctatgaagcaatcaactttgctggtgcttaccatgcaaacgctgtattctacatccaaaacaacggttttgcgatttcaacacctcgtgaagttcaaagtgctgcgccaacattagctcaaaaagcagctgcagctggtatcccaggaatccaagtggatggtatggatccattagcagtttacactgtctcaaaagcagctcgtgaatgggcagcaaatggcaatggaccagttttgattgaaacattgacttaccgttatggtccacacacattatcaggggatgacccaacgcgttaccgttcaaaagatatggacagcgaatggcaacaaaaagacccattggttcgcttccgtacgtacttgactgaaaaaggactatggtctgaagaaaaagaagaacaaatcattgaacaaactaaagaagaaatcaaagctgcaatcgctgaagctgaccgtgtacctaaacaaaaagtttcagatttcttgaaaaatatgtttgaagtacaacctcaaaacattaaagaacaaattgcaacttacgaagcgaaggagtcgaaatagtcatggcacaaaaaacaatgattcaagcaattacagatgccttagctgttgaaatggaaaacgacaaagaaattttagtctttggtgaagacgtcggtaaaaacggcggggttttccgggcaacagaaggtttacaagaaaaattcggtgaagatcgtgttttcgatacccctcttgctgaatctggtatcggcggtttagcttttggtttagcactagaaggtttccgtccagttccagaaattcaattcttcggattcgtttttgaaacatttgatgaaatcgttggacaaatggcacgtactcgctaccgtatgggcggcacacgcaacttgccaattacgattcgttcaccatttggtggtggtgtgcatacaccagaattgcactcagataacttggaaggattgattgctcaatcaccaggtatccgtgtcgtgattccatcaaacccatacgatgcaaaaggattgttaattgcttctattcgcagcaatgatcctgttgttttcttagaacatatgaaactttaccgttcattccgtgaagaagtgccagaagaagcgtatgaagttccattggataaagcagcggtgactcgtgaaggaacagacgtatcgatcatcacttatggtgcaatggttcgtgaagcaatcaaagcagcggataacttagcaaaagaaaacatcaatgctgaaattatcgatttgcgtacagttgctcctcttgatgtggaaacaatcattaaatctgttgaaaaaacaggtcgtgtggttgttgttcaagaagctcaaaaacaagcaggcgtaggcgctcaagtcgtttctgaaatttctgaacgtgcggttctttcattagaagcaccaattggacgtgtatctgctccagatacaatcttcccattcggtcaagcagaaaatatctggttgccaaatgctaaagatatcgaagacaaagtgaaagaaatcgtgaacttttaatagttgaagaagggaagaatagaaaatggcatttcaatttaaattaccggatatcggtgaagggatcgcagaaggcgaaatcgtaaaatggttcgttaaacccggcgataccatcaatgaagatgacactttattggaagttcaaaatgacaaatcagttgaagaaatcccatctccagtcacaggtactgtaaaaaatatccttgtatcagaaggaacagttgccaatgttggtgatgtattagtagaaatcgatgcacctggccatgaagacaatgaaggagatgcaggtgtggcagcgcaagcccaaactcctgcacaaccagctgctgttccaacaacgggagctgcatctgctggttcttcagaaggcgaaggcgtattccaattcaaattaccagatatcggtgaaggaattgcagaaggcgaaatcgtaaaatggttcgttaaagctggcgacaccatcaatgaagatgatactttattggaagttcaaaacgacaaatcagttgaagaaatcccatctccagtcacaggtactgtaaaaaatatccttgtatcagaaggaacagttgctaatgttggtgatgtattagtagaaatcgatgctccaggacacaacagtgcaccagctgctagttctgcagcgccaactgcagcgccagaaaaagttgaaacttctgactcagcaagtgtcgttgaagctgctgatccaaacaaacgtgtattagcaatgccttctgtccgtcaatttgctcgtgaaaaagatgtcgacatcacacaagtaactgcaactggcaaaggtggccgcgtgacaaaagaagacattgagaacttcctatctggtggcggagcttcagcaactgcagaagcagcagctccagcaaaagaagaagcacaagcaccagcagctgaaagcaaaccagcagcaccagctaaagccttcaagtctaacttgggtgatttagaagaacgtgtagcattaactccaacacgtaaagcaattgcgaaagcaatggtcaacagcaaacatacagcacctcatgtaacattgcatgatgaagtagaagtaacaaatctttgggataatcgtaagaaatttaaagaagttgctgctgccaatggcacaaaacttactttcttgccatatgttgtaaaagcattgactgctacagtcaaaaaattccctatcttgaatgcttcaatcgatgatgcaaaacaagaaattgtgtacaaaaactactacaatatcggtattgctacggatacggatcatgggttatatgtaccaaatgtcaaagatgcagaccgcaaaggaatgtttgctatcgctgatgaaatcaacgaaaaagctaaacttgctcatgacggcaaactttctgcagatgacatgcgcaatggaacgatcactatcagtaacattggttctgtaggtggtggctggttcacaccagtaatcaactaccctgaagtagctatcttgggtgttggtacaatcgcgcaacaaccaatcgtcaatgctgagggcgaaatcgttgtcggccgcgtaatgaaactttcattgagctttgaccaccgaattgttgatggtgcaacagcgcaacaagcaatgaataatatcaaacgtctattagctgatccagagctattaatgatggaaggatgattaacaaatggtagttggagattttgctgttgaattagatacagttgtaatcggtgcgggacctggtggctatgtagctgccatccgcgcagcggaaatgggacaaaaagttgcgatcattgaaagagaatacattggcggtgtttgtttaaacgttggttgtatcccttcaaaagcattgattgcagcaggacatcattaccaagaatcactagattcgacaatgtttggtgtaacaagcgaaaacgtatctcttgattttgctaaaacacaagaatggaaagacaacaaagttgtgaaaacattgacttcaggtgttggcttcctattgaaaaaacacaaagttgaaacaattgaaggggaagctttctttgttgatgatcacacattacgtgtgattcatcctgattcagctcaaacttattctttcaataatgcaatcattgcgacaggttctcgcccaattgaaatccctggtttcaaattcggtggacgtgtgcttgattctactggcggattggcattgaaagaagtgcctaaaaaattcgttgttatcggtggcggtgtcatcggttctgaacttggtgctgcttatgcaaaccttggagcagaagtaacgattcttgaaggttctcctcaaattttgccaacttatgaaaaagatatggttaaattagttgaagaagacttcgctaaaaaaggcgtaacgatcgttactaatgcaatggctaaagaagctgttgataatggcgatagtgtaacggttaaatacgctgttgatggcaaagaagaatcagtgacagctgactatgtgatggttacagttggtcgacgtccgaatacagatgacatgggcttagagcaagccggtgtcgaagttggcgaacgtggattaatcacagttgacaaacaaggccgtacgaacgtatcaaacatctttgcaatcggagatatcgtacctggtgcagcacttgctcataaagcaagttatgaagcaaaaattgctgctgaagccatttctggtaaaaaagttgctgttgattataaagcaatgccagcggttgcctttactgatccagaattagcttctgtcggtatgacgatcaaagatgcaaaagatgctggaattgaagcgaaagcttacaaattcccattctctggaaatggtcgtgcattgtctcttggtaaaacagaaggatttatacgcttagtaacaacagtagaagacaatgtgatcatcggtgcgcaaatcgctggtttaggtgcaagtgatatggtttcagaattggctcttgcaatcgaatcaggtatgaacgcagaagatatcgcgttaacgattcacccacatccatctttaggtgagatcaccatggatgctgctgagttggcattaggcttaccaatccatatttaatgatagaagactcgttcatcctttcgatgagcgagtttttttatgtgatcaagtatcagtgaatggcataaaatactgacggttgcctacttgattgctgtagcaaatctgtctgaattatgctatattaagttgctatctaaaacggatgaaggcggggattgtatgcgtaaacaattgggtgggaaaacgattcgtctctattatacaagtctgcaatttctttattggatgatgttttgttcaatttatggatttgccacattatttctgatttattttaagatcgatccagcaaaaatcggtgggatcttagcacttatcaatattttttcagccgcgcttcagcctttcatcagtcaagtgatcattaaaagaaaaaggattcccttgattgctgtcctaaaagggatgacactgagcctgattatcgctcttctagtagggttattactgccagcactgacgattatcagttttatcattggtgcaatcgtgctagtttccatgcagtcatttatcaatgctcttgcatttgagtatgtgaacactggctatgggattaattttggtttttcgagagcaggcggttcactaggatatgccgcaacctctttcttattagggcagttgttggcgagctattctgctgcgcttctcccaataatggcattagtagaagcaggactgttttttgtcctcttacttttgctgcccacagtgaagacaagggttctgccgttgaagatagaagagaagcattcgggtgggttaggaaaaaaatatccttttttacttttgttatttataggattcagctttctgttcagctttcacacaatgatcaatagcttcttggcacagatttttgcttcgatcggaggcggcagcaaagaaataggaatttcattaatgattgctgcattatgcgagttgccaggaatgatattcttcgaacatttggtcaaaagaaagtccagcaagttttggcttttgttttctagtatcgcatttgcagtcagaggagtaatgatgttgcttatcagcacgattgttatgatggaaatgacacacctattgcagggctttagttttgctttatttatcccagcgtctgcttatctcttcaatcacgtattggcagatgaagatcgggtatttggacaaacgctgatcattattgcgacgacattaggcggtgtgctggggaatatcttaggcggcagccttttacagaacttcggtgtctggcagatgttattgtgcggcacgtgctttgctttgattggagcgttattaacgctatgggggatccgtaagctgccaaaggcctctgctgtttccgatctttccgaatagcagacaaggaatgacaaaaatagctagagcaatgttcaaaaatgataacgaaaaagagtggcgatgattgttcgccactctttttcgttaaagtgaatcagcctagccgggttatttcttttctaaaacagcgatgaattcccgcatataatcgggcaggtcaggtggtctacggcttgaaacgatatgaccgtcggtgataactggtgtatccacccaagtagctccggcgtttgtcatatcgtcttttatgccaggggtgctagtcacttttcttccttgcaatatattcgcggaaatcaagacccagccggcatgacatatttgaccaatgactttttcttctttgtccattgcttgaacaaaagaaatgacttgtgggaatcggcgcagtttatccggtgcccaaccgccagggactaagatggcatcataatcagccacatggatgtcgtcaaaagcaaacgcggattctgcaggaactccgtattttcctttatagcttttatgggcttcttcgccaactaaatccacttgagcgccttcttctcgcaaacggtgaacagggtaccaaagctctaaatcctcgaaatcattgtcgactaacgcgatgatttttttattttctaagcgcaaatgaaatcctcctttattcttgctattcttactgtaacatcaaggaaaaggaaacaccaaaagaatgcttttcaagaaagacgactagcatttatctgtaaagtttagccgcaagggtaaaaaaagcagtcgttaaagaaaatagaagatcaatgaagggatagttctagcagtgtaagcgttgtaacgaataataaattaggtcataatcaaagtaaccaataagtcttagcaagccttaacaagtctgaacagatctgaacaagactgaataggagcgtgaaaatagggaaccttttgaaaaagctagacaatctatttaccagaatgtacgtccattggaacttgcacgctggcagattcattttgaagacggtagtcgggagaatgttttacagatgttagaggtctatcaaaacgaggatggcggctttggtcacggcttagagccagacaattggaaacccaacagcaccccgattgcggcgtgagctgcctgcagtattttatgagagatcaattgccttgatgctaaaaatcctataatacaggggatcttgaggtagttgtccagtgcgaaagatttttctgaagggaaatggcggaaccaagtacctccgactgcttttacccccatgccatctggtgggagagtcctgtaggtgtgccggctaataatcccaccgtgagttttgctggtatgatcatccgcgtggaagctactggtttatctcaacaaacggagggaatccttcaaaccgccattgaagctttctcaatgagacaacgatgataggcatacattagtcgtttaattggaaatactaaactattgtaaaaaaacacatgatcaacctcttttggcgaacataaattttcaagaagtgttgttccaacaaattcgtcaaaccgtctcgaaagacccagaagaatggttcacttcttacaccagcaaaccatcggactttttttctcgaaagaacaaatgctcaccatttttgataaagaactttgtcagcaagaagccgctaaaatctcagagaaccagctagaagatggttctttccctattccatggcaatggggcacagaatatacaaagttttatatcagcgtgaattggtggaaatccgttcagatcatcaagaattttttatttttgcatgctttttcaaaataatttgaagcttctcattgcagtttgatttagaaggcggtactttgaaagtaaaggagggactagtatggtcgatgaaaaaaagaaagatttcaataagatgctccatgagacgaaaggaatgccgaaaatcaagcaaatcatagatgaaaagagtattgagaaatatgggggaaagagaatgcttttggctcctccagtggattacaatcaaatcatggggcgtatcccattaggccaagtgatgacgattagtaagattcgcgagtatctggcagaaaggtatggcgccgatttcacagatccaatcaccgcgggtatttttgtttccatcgcagcatgggctagtgaacaaagaaaaacagataaaattcctttctggcggacattaaaagcgaatggggagttaaatcctaagtatccaggcggaatcgagaaacaaaaaagcgctttggaaaacgagggacatacgatccttattaagggaagaaaaaacctacgctattatgttaaagactttactgaagttctagcacaactatctaaatgaaccaacgtggaatgagttaaggtatctcgtattttagttagagctaggactaagctcgattaagtctgtaaaaggcgatatagcctaggcatcatggggtcttcttcaaaacattcgttcattttttttaaatagggggtgcatctctcattgagagctgttctcttttattttgcgacagagtctctgaccaatttgtatttttatggtacactgaataggacgaataggggtgattaaaatgcgtgattatcaatatcctctagatctggactggtcaacagatgaaatggttattgtaatgaatctatgggatcgcttagaacaagcctacgagaaagggatcccggcagcggagtttttagaagcttatcagcagtttaagaaagttgtgccaagtattggggaagagcgccgtttaggcagagatttcgaagacttgagcggatactcattgtatcgaacggttcaagcggctaagacgacaagcggtaaactgaaaatgaaggagtagaaagcaaccatgcaagaaatcgttagtgaaatccatagctggatgattgcagcaggggaaaaaatcaaagaaaacctaaataaagagtctctgatcgttgaaacaaaatcaggtcggaaagatttggtgactgaactggataaggcgacgcaggattttctaattgagaagattcaagcctttgacccagaagcaaaaattctaggggaagaaaatggtttagatcgactttcagattttagtggacgagtatttatcattgatcctattgacggaaccatgaatttcgtgttggaaaaagagaatttctgtatcatgattgctgtatatgaagaaggccaaggacgttttggctttgtttataatgtcatgaaaaatgaatttctttggggtggtccggaaattggggtcttttgcaacggaaaaaaaatcgatccgccgaaagatatcgctttagaggaaggattgatcggattaaatgcgcccatgttgatgcataatcgtcatcatgaagtcgaaatgagtgaacgggcactaggtgtacggatgaccggttgtgcgggcatcgaattgattgcgctggtcttaggtcagcgcgcaggctatatttccaacctagcgccatgggactatgcccctggcggtatcttaatggaaacattaggtttgaagatggcgaatatcaccggagaggaacttgctctagatggtcgggaattgtttattggtggcacaccaacagcatttcaagaattattgacgatcgcaaatcaataaatgacgagcagatatctacgggtatctgtttttttctgtaaaaatgaaaactttgcactatatttcagaaagaaattctggtataatggcttgtcgagtgcaatgtcaccaaaaaaggagtttataaattgaatattagaaatgatatccgcaacgtcgctattattgcccacgttgaccacggaaaaactacattagttgatgaattattgaaacaatcccaaacgttagatagccatacccaattacaagaacgggcgatggattcaaatgcgatcgagaaagaacgtggtatcacgatcttagcaaaaaatacggccgttgaatacaatggcacaaaaatcaacatcatggataccccaggacacgcggacttcggtggagaagtggaacgaatcatgaaaatggtcgacggtgttgtcttagttgttgatgcgtatgaaggaacgatgccgcaaacacgttttgttttgaaaaaagcgttggaacaacatttagtgccaatcgttgttgtaaacaaaattgataaaccatctgctcgtccagaacacgttgtcgatgaagtgttggaattatttattgaattaggggcagatgacgaccaattagatttcccagtcatttacgcttctgcaatcaacggtacatctagtgcatcagacgatccagctgatcagcaaaaaacgatggcgccattgttcgatacgatcattgaacacattccagcaccaatcgacaacagtgacgaacctttgcaattccaagtatcattgcttgattataatgattatgttggacgtatcggaattggccgtgtcttccgcggatcaatcaaagtcggcgaccaagttgcattgatgaaattaaatggagaagtcaaaaaattccgtgtaacgaaacttttcggtttctttggtttgaaacgtttagagatccaagaagccaaagccggtgatttgatcgcggtttccggaatggaagatatcttcgttggtgaaacagtgacaccaattgatcaccaagattcattacctgtgctgcatattgatgaaccaacattgcaaatgacattcatcgtgaacaattctccttttgctggtcgtgaaggaaaattcgttacagcacgtaaaatcgaagagcgcttgatggctcaattgcaaacagacgtgtcattgcgtgttgatccaattggacctgactcatggatcgtttctggccgtggagaacttcatttgtcgatcttgatcgaaaatatgcgtcgtgaaggctttgaattgcaagtttctcgtccagaagtcattgaacgtgaaattgatggcgtgaaatgtgaaccatttgaacgtgttcaaatcgatacaccggaagaatacatgggatcagtcatcgaatcattgggcatgcgtaaagcagaaatgcaagacatgatcaatacaggaaatggacaagtgcgcatcattttcttggcacctgctcgaggattgatcggttatacgacagaattcttatctatgactcgcggttacggcatcatgcaccacaccttcgatcaatatttgccaatgatccaaggtcaaatcggtggtcgtcatcaaggcgcactggtttctatcgatacaggtaaagcaacgacttactcgatcatgagtattgaagaacggggaactgtttttgttgaaccaggtaccgaagtatacgaaggaatgatcattggtgaaaactctcgtgacaaagacttaaccgttaatatcacgaaagcaaaacaaatgactaacgttcgttcagcaaacaaagaccaaacatccgttatcaagaaacctcgcattctttctttggaagaatcattggaattcttgaacgatgatgaatactgtgaagtaaccccagaaagcattcgtttgagaaaacaaatcttgaacaagagcgaacgggaaaaatcacagaaaaagaaaaacagctgataaataaaacacctaaggaagtctaagacttctcgtgtagatgattttccgaaggatggaaaaggaattgctcttgtggtgcagcggctcttcgccgcagagcctaaaagcaatcagccgattctatccttcggatgttttttgttcaaaatgttggcgaagagccatcatcgaaataaacagcgcttgcaatttcagtgattcctttttaaaatgagaaaagcaagtacaaaggagaaacctatgaaaaattatcctgttaagaagaatcaggaacttgaggtcgatattttagatctttcccatgaaggaaacggcatcgccaaagtcgatggctatttactttttattgaaaacacattacccggcgaacgtgcgttagtcaaagtgttgaaagttggcaacaaattcggttttgccaaagtgatgaaactgttacaaacgagtccagatcgtcaagaactgcctaatgaagatttgttgcgaaccggtatcgcacctttgagtcatttgaagtacgaaaagcaattggcattcaaacaacaacaagtagagaatgttttagcaaaagtcgcgaaaatgccgcaagttgaggtattgcctacgatcggcatggaacaaccttttggctaccgtaacaaagcgcaaattcccgttcaaaaaatcaaagggcagttgactactggtttttaccgcaaaaatagtcataccttggtgccaatcgaagatttctatatccaagatccggcgatcgatcaagcgatcgtaaccgtgcggaacattttgcagcgttttaacgtcaaagcctacaacgaagaagctcacgaaggctttttacgacacgttgtgatccgtcgcggacaccactcaggagaaatgatggtcgttttagtcacacgaaaagcgaagtttttcaaaggagaagagattgctgaagtcattcatgaagagcttcctgaagtagtatcggtgatccaaaatatcaatgaagaaaaaaccaatgtcatcatgggtgatgtagagaaagtcctttatggaaaagcttcgattgatgaccaattgttcgataagacgttccaaatctctgccaaatctttctaccaagtcaatacggcccaaacagaagtgctgtatcaaaaagcgtttgaattagcagatctacagccggatgacattgtcgtggatgcatatgccggaatcggaaccatcggaatcagtttagctgatcgtgtccaagaagttctcggaatggaagttgttgctgaagcggtcgaagatgccaaagcaaatgctgcgagaaatggcttagaaaatgttcattactttgtaggcaaagcggagaagattatgcctcaatggttacgtgaaggcattcagccaactgttgtctttgtcgatccgccaagaaaaggtctagaagctagctttatcgagacaacggctgcggttaagccagagcgcattgtctatatttcttgcaacccagccacactagcacgtgatctagcgctatttgcagaagaaggctatgtgacaaaacaagtccagccagttgatctattcccacaaaccactcatgtggaatgtgtggtcttgttgaccaagtaagattaaacaaatatcagaacgactcagaaaatatcctgagtcgttctttttaagtagatgaacaaaagctagcgattacgagaagaaggcgcattttaatgtaataaactaaacgcgacaacttaatcttgataataagcaataggttgcatataatataggtaacctattacctattgtgaaagggaaatgctgatgaaggccccagaaaatcctagacatctattatttggtggaacatttattctagcgaacaaactccaatttgcaggagacaaatctgtcactggattaaccacgaaacaatggtttttactaatgaatcttagagaactttctaaagtgagtgtacctagtgtcaatgaattagcgagtacgatgaatacatcaagacaaaatattgccaagatgctcgacacaatggaaaaagaaggacttgtatcagttagtcaaagtgcccaagataagcgagtcaaagaagtttttataacaaaaaaaggacaacaattggcaaaacaaagtgaaaaagaaagtcaagattttcgagataaagtttttacaggaataacagacaatgaattggcaattgcttctcaagtcacactaaaaatgatagagaatctggaacgcataatcaaggagatggatcatgatgaaggataacctagcggttgtatacttttctaaacatgggatgacagaaaaatatgccagatggattgcagaagagttgaacgcagcacttatcgacgggaaaaaagtcaaagacgtagaattgcgtaaatattcatttgtcatttttggcggtcctatttatgctgggaaaatcactggtgttgatttactgaaacgaaaccttttcgatcatctggttgtatttacagttggtctgagcgatcccgtcggtacggattatgctgatttagataagagtcttcaaaaattaaaaagcattcccgaaggtatttttcattttcgaggcggaatcgattatacacaattaagcatggcaaataaactgctgttaaaagtgataataaactcgttaaaaaaagtacctgatgctgaacttacttcggaaaacaaagcattgatcgaaacatatggacagacggtcgattttagtgatagaaccgctattgaaccgttggtagcttatgtaagaaagttagttgagaaggaaagttaaactgataaagtcatacacttaatgaggtggatgattcatcttacatatggattgaatggattgttaaagacgtctctgcaaaagagtcgtctttttgttttcaaaggcaaaccaatttaatcaaaattggtaacttctgaagtagatgattgattcattctccattttactttcaaacagggaaatagtaaacttgaggaaaatcaatgcgatagtttttcactcaccgttcaagacattcggttgaaaaaataacaaaaatcctgcaaaacggatgcttatcgggttttcttcgaacaggattgaccagagaaacaaggagagttgctagagacgtgctactaagtttttttacaggaaatccagtttatatttgcttgcagtctaatttaggcagaggagaaggctatggataaactttatttggaagacatagaagagattatcgcacatcgatacgacaatggcgccgattactggacgactgaggaccgaaaattattgaaaggggctccgtttaccacgttagaaagtccaatgtacttacttgaactgggagtgtctccccaggatgcgatcctaacagaaacagcggagctgattttcagcacttggagagaagatggtcgtttcaaaacttccccatctggtgggctgtatccttgccatacggcgttagccctaaggaacctgtgtgttctcggttatgcggaagatcaacggcttcttaagaccttcgactattttatttccacacagcaagaagatcggggttggaaatgcaacaagtatagctttggtcgaggacctgaaacggagcattctacaccgatgacgactttaacgttattagatgcctttcgctatagtccattcggaaagaatcaagcggttatccatcctgcgatcgagtttctgttgacgcattggagactgaaaaagccaatcagtccttgtcattatggcattggcacgctgttcatgcagacggaatatccttttaggggatataatctcttttattatctgtatgttttatccttttacccttatgcgaaacgagatgagcgctttttggaagcgttacaccaatttgaaacaaaattagtagagggcaaagtcattgtagaacgtgttgtgccgaagttaggaaagatgaatttttgtaaaaagggacaggccagtcaattagcaacgaaacgttatcaagaaatattaaccaacttagcatagcatttttggcaattcagcagaacaggaggcaagaaaatgacagaaacttgtttgacacttcgtccattgaccaatgagatcgaactagtcgatcgctggttaagaaaagagtatatcaagaaatggcttggttcggcagaagattggttgacggaaatcagaaatgaaacaggagaatttgattatatccatcattttatcgtccttcttgatgataagcccatcggattctgccaatattacgtgtgtgaaaagaccgttaaagggtacccatgggaacatgagccggctggaacatttggcattgattatttcattggggaagagacgtatctcaaaaaaggatttggaaatatgttgatcaaagcactcgtcatccatatcatgagccatgaacaggctcgtcgaatcattgcagatccagtgccagaaaatcaagtttcaatcgctgtgttggaaaaaatggctttgaattggatgaaggaactgggctttatttcaaagatctttcagaatgaatgttgaaaagcaaggcagttacgaaaactatgctttttatctaagaagtaaataggtgtgttgaagtggactagagacgaaaagaacttttctttaaaagtgttcttggtgcagaaacgaaagtgaacctggtaaaggagtcagaagaatggatcgatatgttgctttattaaggggaatcaatgtcggcgggaaaaataagttgagtatgtctgaattaaaagaagaattaaagaaagacgaatttacagatgttgtcacttatctaaacagtggcaatgttatcttttccagtaacagagaggacccacagattttagccaataaaatgagaacaaggatcaagctcggctttgagttagacattcccattcatgtgattttacaagccgaactaaaagaattattagcaaatgctcctgaatggtggggagatgagaacaaagaaatttatgacaacgtcatatttatgatgaagccattgtcttttgaagttttactgactgagattggtgaaccaaaagcggactttgaaagagtgtatccttataaagacattgtcttttggtcctttattcgcaaagaacatcaaaaaacaaattggtgggcaaagaccgcaaagccaaaggtaaaggatcaactgaccatccgaacagccaatactgtaagaaaaattgttgacatgtgatcaaagaaagtcctgtcaattattggctgattccgctcttaaactcattgtgaaaggtttaggtagtgttctctaattactgggttttattggtcataaattgactttgagtgtcgcttttttcaaagcatggaagaaatcaattgaatgcaaaactattctgaaaattttaattctccgaagaaggagccttgtaatctatttttaatggatttatgcttattcttgaaaggagaatgatgatgaaaaaagcagaattgcatgagttgattacgagtacccagccaaatatttgtcaaattgttgcttacaagaaccacgaagaagtctattcagatgaatggaatcattatcagagaaatgatacttgccatgtaatgtcggcgacaaaaagcgtagtatcgttgttgatcggaatcgccatcgatcagggaaaaatttatagtattgaagataaagtccttgattattttcctgattatagcgtgaaacgaggagaaaaaacgatctatgacgtgaccatcaaacacttactcaccatgcaggcaccttataaaggaaaaggagatccttggacaaaagtctgtactagccaagattggacgaaagcttctttagactttttgggtggaagaaaagggttgacgaatcaatttgattatcgaacagtttgtctgcatattttgactggtttattatgccaagcaacaaaaatgaccacggttgattttgcaaacagctatttatttgaacccatcggcgttagtcgacatcacaattaccatgccgaaacagcagcagaacacaagcagttcactatcggaaaagagccaaaggagccggtttggttttgtgatccattgggtgttggtacagctggttatggtttgtgcttgtcagccagcgatatggcgaaaattggcgaactctgcttgaaccaaggccgacacaaaggaaaacaaattgtctctgctgaatggatcgcagaaatgagtacaccaacgcagccagctctaatccaatttcagcagatgcactatgggtatttatggtggatactagacccaaagcagaatgtctattcagcaattggcaatagcggcaatgtcatttacgttgattcgaaaaacaaactggttattgctgtaaccgcgtatttcaaacctacggtccttgatcgggtcgactttgtagaaacgtatgtgaagccatttgtcctgacagaaatagtctgagcccttcacttattgaagggacgaatggaaaggagcggcgactgcgttccatgagaatcttcttaaaagaacgttgaacgaatgagcatttcttggacagataccaacacaaattaacgataacggaggaactctatggtcaaggcaacgattcgtgccagtattgatcaggatatccaaaagatatggcaaattgtcaccaatcttcaggactattcctggcgaagtgatttaagtaaaattgaggtgatcaatgaaaggcagtttatcgaatacacaaaaagcgggtatcccacaacatttacgattatcgacaaagagcctttcacgttgtattcatttacgatggaaaacacaaatatgcgagggcgttggcaaggaaaattcaccaaatcaggtgctcagacagatatgatctttacggaagaggtaacgctgaagaagttttatttgaaaccatttgctaaaagatatttgaagaagcaacaggagaaatatctcgcagatttgacagcaatcctaaaaagagagaaagaagttacggaaaaatcccattgaaatgtatttcgttgctggctgccaaccgcagcagactgcagcacatcaagcatagaacagacaagaaaatgacttgagacaatcacaaaagaaaaagttttaaaggagttgaccaatgtttactttcgagagagtgactgacgcaaatgaacaggaagctgtttccatctatttaaataatcagccgtacttttctttaacggatgatgtggcttccttgcagttattaaaacaagatatggtagataagcctgaatcagtaaagaaagaaaataaacgctttttttagttagaaaggatacaaagccggtggcgatcattgactacttagttgactatccagaagagcaaaccgcttatattggattattgctgatcaatgaaaagaggcaaggacacgggaaagcaatcgttcataaattagaagaaattcttctttctgaagggatgacgaaactagccttggccgttttattgaataatcaaccagcgggtaaattttggcgatcgttaggttttcggcccactaaagaaaccattgctcaaatgaatcaaaagaaagtcaaggttctttcttacgaaaaaatttttgttcacccaagatcaaggaactagcgagtctattttcaataagcaaaacgtcagttgactctctacttgagataagggtcaagatgcaatgaggaggggtatcatgtatttttgcacaccacgttgttttatccgtgattttaggatcgaagatatcccaacagttatgacctatagaaatgatttagagtggatgaagtaccaaggtttcaaaaacagggaaaaagctgcgtatatcaaagaactgctgcatacaaaaagtttttctgaaggcaaaaatttagcagttgtgcacactttagatgaacggctgatcggtgatatctatttaaaaaatgaagcagattttttctggatcggttacacgatccatcctcatgagtctcaaaaaggatatggctcagaagtgattcaagcgacgatacagtggctgtttgatcaaggtgttcaatcagtaaaagcagaggtagcgcctggaaatctagcttcgataaaacttttagaaaaaattttttttcgttagtcaaaacggaagaagacgcactctatcagttgcatcgccttgactacccacaacagaaaaataggataaaacaggaacagtgaatcagaaagttctcttcaaacaataaaaatctttttaccttgttaagaagcctaggctaacttggtaaaaagattttttttgacgaatccgcttcacgtttctttgacaaaagagttggtaagtgctcctaatttggtgatggttcgagcaaagattacgcttttctattttctccatttatttaatgcgggcatcattcgctcaaatacggggaataagatcaaataaaacaggaagtttccgctagcatgaaacaaatcaaatacgaagccttgaagataataggctgtaaaagaaggaaactgataaagccagacttccatcatagaaacgatcaaaccgtatagaataccacaaatgaacgctagaagtgcttggattaagcggctttgctttatgagagatatttttcctcccagatgaaaaaaagtaatcatagcagccagtgctacaaattggctgatcgtccaaggccccatccataaatagatatttgtaccaagcaaactcaataaagcaacgatcaaagcatcagacaaactgcctgccagggctaataaaaataaaatagcactcatgggctgaacgttggggatccagacaaaaaataagcgtccaacaatacaagacgcagtaaggagtgctaatagagaaattttttgaacggaaaatatatggctatgaggctggaacatcgaaatcgccgtctttctaattgataatcattctcattatacatgaaaaaaaataaatttcaagattgaaaaacacattatgtagtgtgataatgaattccggacacaatatgttgagtatgggaaggtggcacaaaaaatgaaatacagtaaacaaacgataagcaagctaaacgaggacattcatatgttcccagaagtctcagcaatcactactgagatgacgaacacatttgaaggaatttctcgcttgatcatgctcgatcgctattctttcaaggatcaaaaccaccaaacattagataagggtgatttggttattttaaccacaaaagaagatcctcaatatcctgctcgaggcatcggatgggtaaagtctattgatgacgacatggtctccatagaggttgaagaagagtatcgctcagctatagaaaatactgctgaacaagttaatggtcttgtcaaacgacggaaaaatgagatcgaaaaaccactggaactttatttcgaacaaatcgctcgccgagtcgctagaaggatttccgataaagagttagagcaggagttgtttcttgagcagttttatcagcagattgccgaacaaaatctgattccggcaggtcgagtactttatggcgctggtactaattctcaagttacctatttcaattgctttgtgatgcctttcattcacgactctcgtaaaggaatcgctgtacacagacaagaagtgatggagattatgagtcggggcggaggagttggtactaatggttcaaccttacggccaaaagcttgtgtggtccatggtgtcagcgggcgatcctctggtgccgtctcttggttgaatgacttagccaatttgacgaatctggtcgagcaagggggaagtcgtcgcggcgcacagatgatcatgatggctgactggcatccagacattttggcgttcattatttctaaaatccagaatcctgcagtattgctgcagttaaacaaaacattgaaaaatgacactatcaaacagttaatcaatgaaaaacttcattttgatcctttgtcaaaaatggaagaaaaaatgtatacccatattgctcagcttccagaatcatcagataccgagcaaaatgaaatgatcaagacagcaaaagaaaagctacggcatggaggaagttatacggttaaaaaaagcgacttcctgactggagcgaatatttctgtttgtttgacagaagaattcatggatgcagtaaagaaagacgattggtatgcgctgcgtttcccagatatcgataattattccgaagaagaaatggcggaatacgatgcaaagtgggcagaagtcggagatgtgcgagaatgggaagccgccggtcataaagtaaaaacctatcaaaggatcagggctcgtgaattgtggaatttgatcactttttgtgccacgtactcagctgaaccgggtatcttctttatcgataatgccaataaaatgaccaatgctacagcctatgggcaaaaagtggttgcgacgaatccttgtggtgaacagccgttaacaccttatgctgtatgtaatctagcagcagtcaatttggcaaacatggccgatcatcaaacggggacagttgattttgctaaattaagagaaacggttaaaaccgcggttcgttttcaagacaatgtcattgatgcgaccccttacttctttgataaaaatgagcgccaagcgaaaggtgaaagacgtgttggacttggcatcatgggcttagccgatctactgatctattgtgagaaaacttatggttcagcagaaggcaatcaattagtcgatcagatttttgagacgattgctatcaccgcctatgaagcctccattgatttagcaaaagaaaagggcagttttccatttttgattgggaaagatgatcaagagacacaagcattacgagagaagtttattgacacagggtatatgaaaaaaatgccagcccatattcgtgaaggggtgatgcaatttgggattcgcaactcacatcttttgactgtcgcaccaacaggatcgacgggaacgatgaccggtgtgtcaacaggattagagccttactactccttctcctattttagaagtggcagattaggcaaatttattgagatcaatgcagcaatcgttgaagaatatcttgcgaatcatccggaacaagacaaagatcagctgccagacttcttcatttcagcaatggaactgtccccagaagaacatgttggtgttcaatgtgcgattcaacgctgggtggatagttcgatttcaaaaactgtcaatgcaccgaaagggtattctgtaagtcaggtggcgaaagtctatatggatctctacgatggtggtgccaaaggcggtactgtatacgtggatggcagccgtgactcacaagtattgactttggaagcaatcgacaatgaaataaacactcaagtagaaccagcagaagatcaatttaccacccaaacgaatgaaccagtgatttctggtgacatttgtcccatctgtcatgaaggaacaatagaagaaattggcggttgtagtacatgtaccaattgtaaaattcaattgaaatgtggtttgtaaaaatagatcattagtgattgaagagataagagatatacctgtgtttcagtaaatatttagtatgtttttcgatggataaaagagtagattttaatgacgtatgtcgggaaggaataaataaatgaaaaaattgttagtcgtaatcgtgttgttaggcggattatttgtcactagtggctgtcaaggaaatacgcgtacatcttcagaaaatacccaaaatgcacaaagtgtagaaagcacagaacgttctgttgatcagaaacaattaacagctacgattgttatcacgaataaaggtgaggaagtcacctcaaaagaagttgcttttcaagaaaatgaatcactactgaaagtaatgaaagaaaactttacgattgaagaaaaagatggctttatcacttcgatcgatggaatgagtcaagatcaaaagaacaatgtattttgggtctatacagtcaataatgaaatgagtgataaaggtgcccaaaatctgcttttgaaaaaagatgataccatcacttttaatttacaagcattctgactcacacgttcgcgaggtgtgacataagtttttcaaccgacgaacgttctgaataatgaattgaatgttatattgtgaaatttgtgggattgtgcaatcaacgattgacaaacggtcaaaatccaagtagatttaatcaggatgctaaattcttttatcaaagtgatttgttttatcagataagagagggtctgggaaaacgaggtggaaatagtgaaccaaaaagaaaaaatgcttgaactgatcaaaaagaaacaaggtggtggccgatcgaaacaaatggacacaccaaaaaatgatcgcaagaatatgcgtaaaggaccaaagatttacaataagtaataaatgagcacgactcattgagtataactgcgtaaggaaatcctccttacgcagttttttgtctcttttagagaggggtaccgactgattttctcaacacaaagtactcctcgacttcgccgctttccttttgtatgattaaggaaaagagaataggaacggagtgagaaaatgaatgtgaaagaggcattgatggctggagcagaaaaaagtatctttttgaatgatattgaagtcgatccgaaaaccattaaagcagtattgatcaatgaagtcgttcccctagatccaacagatgatttttatggggcaacagatggcgcttatctttctacgacgttgccgttgtttcaacaagctgggatctatgtagattctgcccatgacttattggatttagggatttatttgaccaatgcgatcaaaacgccaaaacacacgacgacaattgaaacacaaactatcactgaaaatctaccgctattagaaaaagagttgtcgttatttccaaatattgaagtgattatgctaatgggggatgtcgccaaaaaagccttcaatcaaatcgccaaaaagcagcaaaaaaagaatgcgattccctccgttgcaacttataaaatacgccagactgaaatctactatggaaagatccgcttattgccttcttatattatgacagggaagaatgtattgatcgaaaaatctaaagtcacgatggcagccgaggatatcgcgaaaatgtatcaagtgattacgaaggaatgatttgattagcagacgatcccatgagctcgcaggatgacagatcttccgctgaaattataggacacactggtgtaagggacttccagcgaactcatgcgaacctttctgtacaagtattttcggatctgctatacttaaggaaatcatttactgaaggaggaaaagtcatgacagcggcaatgaaattgtggatcgatcttttgaatcgttaatttaatactattcaaaagtctaggtgatcgcgatttcaaaggatgagtgtctacttttccaattacttatgaagggatagcgccaggctatgccttttttgtgttttcctttttcctagacgagagagggagatcattcatggaaacattaacagtccaattcaaacagatcaaaaaacaatatggcgctaaagaagtcttgtcaattgaggcgttatccgcctatcatggagaacgaatcgggatcattggtagaaatggtgaaggaaagtcaacactgttaaaattaattactggagaaatccagcccgatagtggcacgattcagacaaccacgacctttaattattttgcctaaattggagggatcgaggattcttacgatttttcatccgttgactgggaaatcatgagccgcttttcgttaccaaaacattcaatggatagctggagcggtggggaagccgcaaagacacgattggttcgaacactatcgaactatgaaatgggtcttttgttggatgaacctaccacccatctggatcagaaaagtatttcattgcttattgaggagttgaggcattactatggtacattgctttttgtcagtcatgatcggtttttcttgaaccaattagcaacgaaaatttgggaaattgatcaggggtgtgtacgggaatatcacggaaactttgatgcgtataaacagcaaaagaaaatggaattactgcatcaaaaacatgcgtttgaaagtcacttgaaagaaaagaagcgcttggaagcggcgattgaaagtaaacttcagcaagctgaaaagattagtaaagtctctaaaaaaatgcagcagaaaaatagtcgtcctgatcgattggcatcatccaaacaaaaggatacaattcaaaagaatcttcataaaacagcaaaggcaatgaaaagccgtttggatcatttaggtgagcatcattcattgactgagccgagacaaattatttttgcagcaccaaaaggcatagaaattcataatccttatccgataaaaggacacaacgtttcaattcaatatgaacagagagttttgtttgatgattgtgattttcaatttggattaggaaagcgtatcgcgattgtaggtgcaaatggttgtggaaaaacgactttattgaatcatattttaaatgatggtaaaggaattgtcttatctcctaaggtagtttttgctagttaccaacaattgtcctataaaatgactgaatcggaatcaattcttgtttatttaatgaaacaaaccgattattctgaatcatttgtcagaagtattttgcataaccttggtttttatcaaacagaaattttaaagcccgtaaaaaaattgagcggaggagaagcgacacgagttcaaattgcgctactttttgttaaaccagcaaatgttctcattttagatgaaccaactaattttattgatcttcctacgattgtagccctggaaaaactaatgagggattatcttggaacagttatatttacttctcatgatcaattatttgttgatcgagttgctaatgaggtctatcaagtcgtcgatcaaaaacttaaaaaaatcacttaaacgtatggccattttcttaatcgcatatgctcgtaacgttgaacgcaaaatcgtgaaagggtttgctgcaactgctttaatgtggtaaagtatagtcataattgaatgaacaggtgatgaagttcggcatagctgatagtacacaatcagtgctataggtatgactggaaaagagtaaataaaatcaattgaacaggctaaaaataaccgcttttgtaggtttatttaagttgcctagctattgattttatcttactctaacttctcttttcacggaagcgatgggtaaccatcgcttttttttattcttttatagtaatcacgcaaaaggaggaccaaagaaaactattcagttacacaaataatcaatcaaaggagcagaaaaatgcgaaacaaaatgaaagacttcattaaacagccaaaaatctatcaacaaaccgataccccattctggacagatgactatatttctcagaaaatgctagaaaatcatttggatccgagtatagatggggccagtcgaaatcggtcctttatcaaaaaatctgctagctggatctgtcaaaaagtcccaccagcagattatccaagccttcttgatctagggtgtggaccagggctctattcagaattgtttgctgaatctggctatcaagtaacaggggtagatttctcaaagcgatcgatcgactatgcaaaagagactgcacgaaaaaaacagttgcctatttcctacctaaaacaagactaccttgagatggaattgacagaaacttttgatttgatcgtgatgatctactgcgactttggtgcattatctgcaaacgatcgacatctgctggtagcaaacatttatcgctggttgaagcctggcggaaaattcttgctagatgtctttagtgcaacgaaatatgatcagactgtagtgcagcaatcatgggagtactcagaaggagctggcttttggagcgagaactcctatcttgcattgaataagaccagtaaatatcccaactttgtctggctagatcaaacaatggtgatcactcaagaggatcagataacttacaatgtgtggactagttgttttacagagcactcattggctgccgaactggctgcggttggatttaaagagtatcagctttatagcaacgtttgtggcgaaagctatacgaaagagagtgaaacaatcgcgatgttgctaaagaagtaaacggtagggttacattttaggggacaattcgctaaaatgaagaggagggataaaatgaaaaaagtcttattgtttctgatgaagcttcctttttctgcccatcaaattaatgcagatttgtgaaggaatatagggtaacaatcaaacaagatttgttcaataaatataaaactgcagaaacatcgttgagaggaggcgtatcatggaagaattacaaaaaataccgaatgtaggaaaggttcttgccgaacacttgcatgcgattggcatcgattcggtggagaaaatgaagtctgcaacagcagaaaccatttttatgcgtattcgtacccagcgggatcccggggcttgtctacacatgctctatgggattgagggagcaatacaaggaattcctaaaacgcagatttcagctgcaagaaagcaagaattgcgaacgtttttccagactgtttcttgattgatttgcaaaaggagtcaaaccaatcagatttgtgatctaaaacacaaaaaagaaggaccatacaatgcctgacaacttccgtgaaaaacattggaagtgtctgattgattgttcggtcttttttgttttttagggcatagctttatgctaattacctttaagcagttctctcaaagtaggcatttcttggacttggtatttttctttaaaggcggcgatttcagctgccgaaaatttttctggatccaatttcaattcctctacaggaagtggacgagcattttcgatcttgatatcaataactacagggccgttgctggtttttgctgcatcaaaagcaggtgttaggtcttcgtaacgagtgatggtatatccttttgcaccaagtgcttccccaactttcccaaagtctgcgccttctagaaagactccaaatttcttttgttcggtatcctcttgttctgcttcaataaatccaaaagaatcattagagaagacgatattgatgattggtaattggtatttgacttgggtcaaaatatcctgcatttgcatggcgaaaccgccatccccactcaatgtaaagacttggcgatcggggaaactcaattgggcggcaattcctcctggaacaccgttccccatcgtagcgaaccagccagaagtggtaaaacgctgttctcctgtcatgtctaaatgtcgaatactgttgatcgtcacatttccgacatcactgacgaaaatcgcattcggctcggcaatgcggttaatttctttgaagatcggttctggacgaagaggagcttgttgattggtgtcaaagtgatggcgccaagcatgccagcgaacaatgttttcttgatttgctgccagccattggtctgctggtcgtttggttcctagggtgacccattgattcaacgcagtgatcccatcgcctaacaccgagacatctgtgttgtgccgacgcccaaatttcgaggagtcaatgtcgacttgaacaaaattggctttcggattaaagaaacgacggccaaatggaaaatcgctccccacgaagacaatcagatccgcttcggctagtgcttcgttcgcaggttttgtggcaactcttccggcaaagccaagaaaattcttatacatatcaggaacgattcctttcgccaaaacagaagccgcaactggcattgaaaagaactcggaaaattctttgatcgctggaaatccgccgaataccccttgtccaatataaagaacgggtttttttgcttgttcaaaataggggagggcagcttttaagtctgcttcattaggtaggatcaccccagttttatggtttttggctgtggcgatctcttgggcttcaatctctttaaagccaaaatcaacgggaatcgtcacgacagcgacgccccgaaatttataggcagccttgatagcttcatctaccacgtgtggtagactttcaggggacatgaccgttcgattgtagatgctgacatccgcaaacatcggattttcattcatttcttggaaatcattgtaattcattgaacttgatgccacttgaccgagtaatgctactacgggcacattatccatttgagcatcatacaatccattgattaggtgggtagctccagggcctgctgagccaaagacagccccgactttaccagttagtttggcatcagcagcggcggcgagagcacctgcttcttcatggcgaacttggatatagcgaacggattcgcgttcttggtatagtgcatccattgtggaattaaatgaaccgccgggaatgccataaatgtgatcgatcccccaagcctcaaagacttttaccatggcgacacctgcattgatttttgtcattttcttcactcactttctcctctttctttcagtataaagtattctaaaaaagacaacaaaaaatgtgactcgactcacaagggaaactcccggttatcagcaatcaaattcaacagaggaaaaatagtacaaagaatagaatacctgcaaaaaaagatgcacctgtgtcagatgcatctaaaatcatggtacccttattcagccatcagaggcttgttcgctagaagccctagaagtatgcgattctttatgaaactaattggataattctgcgataaaacgagccgcgatttctttggggcgggtaatcgcaccgcctacaacgatacctgcaacccctagacgctgaacttgtttggcttgttcaggagaatgaattcttccttcagcgatgacgggcaactgttcagcgacaagttgttggatcagttcgaggtcgggtccatctgttggctcacggtctttggtataacccgctaatgttgtgccaacaaaatcgaccccagcttggtaagcattgcggccttcttcaaaagtcgcaatatctgccatcagcagctggtcaggatacttttctttgatttttttgataaatgcattgatggttagaccatcgtgcctttttcgtaaagtacaatccagcgcaatgacttcgacaccggttgcaactaattcatctacttcgcgcatcgtagcagtgatgaacggttcttcaggtaggtagtctctttttatgataccgatgattggcaaggacactttttctttgatttgctggatgtctcgtacagagttggcacgaattccgaccgcacctgcttcttgagctgccaccgcaaaaagagggatcacgccaccttcttcggtataaaagggttcccctggcagagcttgacaagaaacgatcaagccaccagatattgcttgtaaaaattctgttttgttcatggatacagactccttttctcgatttggtagctagcgctacgaatgctactaagttgattttgtcaattttgtcaatttttcaattaagtcagctattcaaagcggcttctacctttgacttcttcaaagggactatagcatggaaaaatggcttttgtaaatgatttctctcggaagcagtcaaatggacaatgactgcgagggctgtgaagatccttctcgttttactgaaaaccgccgctcattctcaaaaggaacacttcaagcaagaaacaaaataagtttagggctttttctcatcaaaaaagctttcccagaattcagattctgcactgagacagaaatgattctgggaaagcgctcttcagttgcaattattttgtagcggctcgtttgaaaacaggaatttcattattagagccataatcattcatagtgatttcttttaattgagtcagatcttcttctgaaattgtaaaagcaacatcgccgttgtttttcatatgttcaatggatgctgttttcggtaaaggaaggagatctaattggaggcaatagcgaatcgctagctgtggcactgatacatgatattttttagccaaagaacgaaagaggcccgcaaacatttactagtcgaagaatgagaaaatttgcggcaacgttttgaggaactaaaagggactttgaatcgtttagataacaaaatcaagtactatgacgagcaatggcaagagtaaggattgctgcattcccgaaagacgaagggcgtgcagcagtccttttttaactattgtttgttttctcagagattacgatatttatcaatgtccaatggctggttttccgataataattcgtagtcaagctgattcgattcatcatcatggataatgtgcagcaattggtttgaatccttgatgggtcctaggctgataatagtaaatcgatcattgattacttccaaattctggagtgcccctgtaaaaactttacgtatatggtgcgcagtttttattttttcctctgctttttctaccgcttttgttaaagtaaagccttcatcaaggaaacgtttgatcaactcaactttgatcaccgtgggcagtcgatatttacgtggcgcattttcttcttgaggaacggattggataaggcctttttgttcccagtaacgcaattgacgcggagagatttcacacattcggctaagctcgctgatccctaccagcaaattgtcattttctaataatttacgaaaggtttgagacatgctttctccattcttgtaaaggtatttgtttatattgtaacttgttttacttttgtgtcaagtaggttgacaaataagtgagaaagttttaaagtgtatagtgctgttgaaaaattttgtgaaaagagtgtgaaatatgacaaataatcgtcctttagatatatacggtaaaccgtacaatcgttctttattggttgtcgttttgctgatcggtacgttttgtacagtattgaatcaaacattactgacgactgcctttccaaccttgatgaatgccttcgatattacggcttctgatgttcaatggttgacgaccggattcttgcttgttaatgggatcatgattccaattaccgcttggctgattaataaattcaattcgaaaaatttgtatttaactgccatgacgattttcttaattggtacaattgcttgttttgcagcacctaatttttcgatcttactattaggtcgtttgattcaagctgccggtgttggtatctccatgccgttgttgcaaaatatcatgttatcgatctttccgccagaaaaacgcggttctgcaatgggaatgtcggggatcgttattgggttggcaccagctttaggcccaacactatccggctggatcattgaccactatacttggcgctatttgtttggaatggtcattccaatcgttattttagtattgatcttagctgtcttcttgatgaagagtgttatcgagctgtctcatccgaaaattgatattttttctgccattctttcaaccatcggtttcggaacattgttgtatggtttttccagtgtcggagacaagggctggggaagcgtggaggtcattagtttcttagtagttggggtcttgtttatcgccttttttgcttggcgacaattgcacatcgagcatccatttttggaattacgcgtcttttcatcgaaaacattcacattagcggccattctttccggtgtgaccaatatggccatggtgggcgcagaaatggtcttgcctttatatatccaaaatattcggggagaatctgcctttcattctggtttgatgcttttacctggggcattggtaatgggggcgatgatgccgatcactggggcaatttttgataagtatggggcaaagcgtttagctattaccggtatgttcattttgactgctgcaacattgccttttgcctttttaacaaaagacacaccgatcttgcatatcgtcattctttatgcgattcgtatgtttgggatttccatggttatgatgccagttactacttctggtatgaatgctttgccaggaaacttgatcagtcatggtacagcagttaataatactttccgtcaagttgccagctcaattggaacggcgattttgatcagtgtcttatcaaatgtaaccaaaggaaatcttccaagtgatggcttgttgaaggcaacaccgcttgcttacaaagaaaaagcgatcgaagcaacactttctggttatcatgctgctttttatgtcgctgttgtctttggctttttaggctttttgattgcctttgcattgaagaaaaaagagcctcagttgactgttcttaaaggaggtgacggcaaatgatgttagtgattgtcgtcatcagtgtaattgcctttgcgttattaaatgtttttgccaaaaataaagtccaaactgttatttcacttctctttggtttggtttttgtcttaagcttaacagcaatgatggccaatctatccgcacattttgggatggaaaaaaccaccacaacgactacacagccgttagtttcaagcagtgacaatgatcagttgccaatgctgttgtatcaacctttgggtgatggaactgagaaaatctatttgtaccgcacagatgagtcgcaaaagaaaccaaaacaaacaagaatggaccatgtgacgaatcatgtcgtcgaagatgccaaatcggcacaaaaagaaacgaaaacgacccgttggacgtataaaaatgatttttatcgtttcttgtttggaatagctgggaatgatgaagagtttattcgtgaaaagaatacgttctctcttccagattcttggactctcttaactgttgatcaagcgaaaaaactagccagtcttgttgaaaaccaacaagaagcgatgaaaacagaagcacaaacttttgttcaagagaagatgcaagccgctttgatggctgacccaacaatggatgcggcggaacaaaaagcaaaaatcagtcaattcactgcagaatatcaaaaagaagcaatagcaaaactgattcaagaagcaaaaaaagaataaaaaaatccctctgctccaagagagtgaatcactcccaaaagttagcttttatggctaacttttggcgaatggttcaatcactctagctgcagagggattttttgttgattaaaaagtgaactgctcaatgcgatcaaaggcttcttttagcattggcattgattgcgtagcagctaaacggacataatgatcaccggtcgtctcaccaaaagctttaccgggaatcattagcacgctagtatcttttaaaagtttttcaacgaaagtaacagaatccaagccagttttttctatgttgatgaaggcatacatacttcctttgacaggagacaaagaaagaaaaggaatagtagcgactcgttgctgaatgtaacttagccgttttttgaaggtttccacgactgctggaacaagttcgtcgtagtgattcaacgcatagattcccgctcgttgtgagggggtaggagcagaataagcaatactttcattaatcaacttggctgtctgattgatggataaaggagcgatcatgtaaccaatccgccagccagtcatagcaaaagcttttgaaaaactgctaaaagtaatcgtccgttcaggcgcaaaagtggccataggaacaaactcttccataaaacaaaaggcttcgtacacttcatctgacaagatcaacaaatcattttcttcggcaacttcagcaattgctttaaaagttgtcggcgaaaagacagcaccagtgggattgttgggagaattaatgataatggcttttgttttgtcggtaatcgctgcttttaatacatcaatagcgatctgaaaaccatctttttcaaaggtagggatgaaaaccgggcttccgccagccatttcaacttgctgcttataaggagaaaagtaaggctcatggataattacttcatctccaggatccaagatcgcgcacaaagcaagatacatgccatgtaacgcaccaactgaggcccgtacttgatcgttggagaaagtcaatccataatgggtctgataaaaatcgacaacagcttgaataaaatcggcactgccatcagaagccgtgtattttgtatgtccatttttgacgtccgtaaaagcggcagcaatgatcgactgatcagtaatcaaatcaggatcgccgatggacagatctatcaaatttggtgttttcttggcaatcgttgcaatgtccattagtaaattttcttcgggtgtttgaaatcgttgtgcaatcatcgactgtttcataggttcatctccattttttatagtacttttcttaaaaaatcttgtgtgcggctattttgcggatggtcaaagatcgcttcaggtgttccttgttcttgaatgacaccgtcagccataaagatcacgcgatccgctacttgcttggcaaagcccatctcatgagtcacaacgaccatcgtcatgcctttctcggcaagtgcctgcatcaccgctaatacttcaccaaccatctccggatcaagtgcagaagtcggttcatcaaaaagcatcacatctggatccatagccaacgcacgagcaatagctactcgctgttgttgcccaccagataaacttgcaggatagctagtcgctttgtctgctaatccaacttgttccaaaagtgcgtaggcttttttctcagcggtctcttgatcttgtttttttacttttatggggctgatggtgatgttctccaaaactgttttatgaggaaacagattaaagttttggaataccatacccattttttgacgaatttgatcgatcacaatctctttagccaaaagatcgtttccttcaaattcgatttgaccactggtaggttgttctaaaagattcaaacaacgcagaaaagtacttttgccgcttccagaaggtccaatgatcacaacgacttcacccgcggagatttcaagatcgatctctttcagaacttctgtcgcaccaaaattttttaaaagtttttttacgctaatcacttgttttcattctcctttctgcaactcctagtaatcgtgaaagagcaaaagtcaagacaaaataaatcaaggaaacaatcacgtatggtaggaaaggtttgaaactggcaccttggacgacccctgtttggaagatcaattcggagacaccaatgacagagacaacagaagactctttgatgactgtcacaaattcattgccgagagcaggtaaaatgttcttgatggcttgcggaaaaataatgaagcgcatcgcttgaacttgattcattcctaatgaacgggctgcctccaactgacctttgttgaccgcattgatccccgcacgaatgatttcagccacataggcggcactattaagtgcaagagcgatacaacctgccgttaacttggataaatccagacctagtacgccagtcccaaaataaacgataaagatctgtactaagagcggggtacctctcacgtattcaatataaacaatcgcaatccaacgcaaaatttttgacgcagaaagtttcataaatgccagtagactaccagcaatcgagccaaagagtacaccgacaaaggctaaaaaaatagtataaccggctcctgagagataaaagggcagatatttgctaaagaagccttcttcaggtgctcctgtttcttcattgaacattagagcataggcttcatcttgatattgactcaatagatcgttatcgacaatcgtcttgatggaagcattgattttttccaggagcagcggcgcctcttttgaaatagcaattgctgtttctttcgtacctttctcaaagaccacatcgtcggcaattgctaagttatcatttgattgaacataggcttccgccacaggaccttccatcacaacagcatccactttttttgagtttaaatttgtgatcagatccggaactttttgcaaagaggttacaagtgagccggacaactcattcttagctaattcttcttgtgtggtttgtttttgagcaccgacagctacaccgttgaaatctgctgttgattgaaaccggttctgatcttcttttcgaacaatcactttttgttggacttccatataagtgtcagaaaagttgacttcctttttacgttcatcggtagcagccatccccgaaatgacaagatcgatttttccagtttttaatgctcctaacagcgcatcgaaacctaattcttcaattttaagatcgacgcctagatcatcagcgatttttttggcaattgatagatcaaagccgacaatttcgtctttgccatcaatcgtggcatgaaattcatagggggcataatccgcagataagccaacgatcaatgcgccattctgttttattttttcatagacgggatctgttgtttcagcgtgtaccagttttgtggtaacacaaaagaacaggacgatcagtatcattgttgaagcgaaccatttacacatctttttcattcaattactcctttttttgttttaaaatacaataatagcttgaattatgtataaaaatacaacaaacgttagaaatatcgtatcatacctttgtgggaagtcaatccctttcttggaaaaatcacgaaatatatttgagttttcagaaaaaacagtgttttctataagtttacaggttgaattgttttttacaaatttgtaatataagaaaatttatttcagaaaatttccggaaattatgaaaatatttaagattcattcggcttttttgattagcttaaaagaaacttgtaacagttaatcgatcttatgtttactattaaagccttatttagcaaggttttaagtctttctattttttatttggtacgttatttaatttcttttatcaaagtgaaatatttcgtcatcgaactgttaccaaggacttaacgtatcttgctattatttatcaagtcgttacgacgaaaacttacatagagcgagggaaataaaatttatgaaatcaattaaaacattcgtattaactacagccacaattgctggttttgctgcattaagtacaactgctaacgcagacgaaatcaaacacgtggtgaaatctgatgacacattatctggtctttctttaaaatactttggtaatttagatcatattgatcaaattgcaaaagacaacaaactgaaagatcctaacatcatctacgatggtacaactctgattattgacaccgacaaaaaagtatcatcagataaccaagcaagtgaacaacctgcaaaagaaaccacacaagcagaagaccaatctgccaacgaaaaccaatctgaatctgcagcaagcagctattctggaacaacgatgacgatggaagcaacagcatatagttctgatccagcagatgttttaggcggcggaactgtgacagctaccggccaaaacttgttggaaaatccgatggcagttgcggtggacccatctgtaatccctctaggcacaagactttatgttgaagggtatggagaagccatcgccagcgataccggtggtgcgatcaagggaaatatcatcgacgtgcatttcccaactaatgcacaatgcgaacaatggggccgtcggaccgttcaagtaacgattcttgattaatttctccaaattttaagaacagacccatgcacgtatgaggctagggcataagtaaaaacagtcagaaagattttcgagaggacagttgttccttaaagatcgggtctggctcaacttatgcctagcctttttgtatactcagataaaaaaggatgcctctatgaactttgcccaagacattttgcttttttcttgagataatgaatcaaagaggaggcgttcaagtgaaggtagtattgatacggcatggcgaaagcgaagcaaattttgaaaactattggacgggctggctggatgtggccttgacagcaaagggtcgggaacaagcttggcaagcgggagaaaaaatcaaagaattgggtatttcttttgatgtagcatttgcttcttatcttcagcgaaccatcatcacctgcaacactgttttggaagcaagcgctcaattgtgggtacctacctataagacatggcggttgaatgaacgacactacggacagttagtcggtgtcaataaagatgaaatggttgctcggtatggaaaagatcaagtccaaaagtggcgacgagggtataatgaaccgccgctgtatgtttcagaaaatcattttgatcgtcgttatgacgacttagatccacgcttgattcctaaaggagaaaacctaggaatggtcgttgaaaggatcacccctttttggtcggatgatgttgttcccttcattcgatcaggaaaaaatgtcttgatcacaggccatggcaatagtttgcgggctttagtgaagtatttggagaatgtacctgaagaagaagtcgacaaaatcgatgtccccaatgcagagccaatcatttatacctttgattcacaagctgttttacaagaacgactgggataaagacgaacattattactaaaaaccgcgctttcgtatgaagtttcatcgaaagtgcggttttcttatgctataataagaaaaattttatgaaaggcgggctcttatgaaagcagtattgaccgttattggaaaagacaaggtagggatcatcgcaggcgtcagccaactattggcagaattagacatcaatatcctcgatgtttcacaaaccatcatggaagaatactttacgatgatgatgttattatcgatggaggcaaatgcagattttgaaacgattcgtgagcaattgcataccaaaggcgaaacactaggtgttaaaatcagtattcaaaaccaagaaatttttgataccatgcataaattataggagggcttctatggaaatcaatcaaatactagaaaccattcgcatggttgaagaagaaaatcttgatattcgtaccattacaatgggaatctctcttttagactgtattgatgccgatatcgatcagatgtgcgaaaaaatctatcaaaaaattacgacaaaagccaagaacttggtgcgagttggcgaacaaatcgaaacagaatatggtattccaatcatcaacaaacgaatctctgttaccccgattgccattgttgtggcagccagtcaaccgacgccacaagactgtgtgaaggtagctaaaacattggatcgggcagctgagacagtaggggtcaatttcatcggtggctacagtgctctggttgaaaaagggtatcaaggcggtgatttagcattgatccaatcgattccagaagcgctggcagcaacgaactttgtctgttcttcggtcaatattggatcaaccaaagctggaatcaatatggatgctgttcggttaatgggggaaacagtcaaacaaacggctgaagcttcagatatgggatgtgcgaaattagttgtttttgcaaacgcagtggaagacaacccgtttatggccggtgcttttcacggtgtcggagaagcagatgtcgagattaatgtaggcgtcagcggtcctggagtggtcaagcgtgcgcttgaaaaagtcaaaggagaatcttttgacgtcgttgcagaaacagtcaaaaaaacggctttcaaaataacccgtatggggcaactcgtcggacgggtagcttcagagcgtttaggggttccttttgggatcgtcgatctttctttagcacctactccggctgtaggggatagtgtggcgctcatcttggaagaaatgggtctggaatccgttggaactcacgggacaacggctgcattggcgttgttgaacgacgccgtcaaaaaaggcggcgtcatggcctgcaatcacgttggtggtttatcgggtgctttcatcccggtttcagaagatgcaggcatgatcaaagcagttgaaagtggtttgttgaatctagaaaagttagaagcgatgacagcaatttgctcggtgggcttagacatgatcgcaattcctggagatactactgcagaaacgattgctgcgatgattgctgatgaagcagcaatcggcgtcatcaaccataaaacaacggcggtacgtatcattccggctaaagaaaaacaagtaggagaccgaatcgaatttggtggtttactaggcacagcacctgttatgaaagttaatccagctaaatctgctgactttattcagcgaggcggccgaattcctgcgccgattcattctttcaaaaactgatcatcttctgaaactgcgatataaggaacacacaaaatcaaatgctctcgattggacgaaaaggtgattacttttcgaacattcgctcataaagacctaatggtattttggaggggatgctagtaaaaaaatcggacattttgtttagtgtagcacttagttcgcagtttcttctttgtgatctaaggctttagccctatgctgatcatctggaaataatatacaattaacgtaattttatacagataggggtgtcaagaatgaaaaagagggtagtgggcagctccatactggtagtgatcgtcatgttcgtgctacttgttccccaaaaagtatttggtcaaagttttgtgaaggataatgcaggggtcctctcagcagagacaatcgcaaaaatcaatcaattaaaccaagagaggttccaaacgttgccaggaagtccagaatacgctgttgtcacgcttaaaaacttagacggccaaacgatcgagacagtaaccaatcagttatttgatgaatacagttttggtcaatccgcgtataacaatggcttagtctttgtgtttgccatcgaggaccgggaatttcgtttaggctatggggatggcttaacgtatattttttctgatttgtcagatgatgacctgatcgatgaagatacaaaagttcttttgcgtgatgaagactatgatcaagctgttttaaatgcttctgatcgcgtctatgaggaaatgaaaacagcggacgaaacggttggtctgaacaaaatttatgcggatgggcaacagctactggcagaaaaaaaggcccgagaagccgcagagtcaaagaaattctggttgctgttttggcaacttgttagttcagttagtgcattgattattgcagctattagcggagtgataggctggcgcaagcgccaaacgaagaaaagttttcaagcagccaatgtgattcctcctcatattcattcggatccagcgtttgatgaaaaggctttttacagatgggcaagtaaaagaaggaattatcagaccttcaatcactatattgttgctggagagtgtttgaaggctttaaaaatgtacctgcttagtgaagttattccgaggcaattagctgagtttgaaagaatcagtccgcaaccagctagaaaccaaatgattcaacaagcattgaaaaatccgcagttggccgatcaattcgtgcaagaatatatgaaagatcataaaaatttgaagatctttgggcaagagttagcccaaggccatgacacattgcgaacctatgaaacacaattgcagcggcaactcaaggaacaattacgagattatgatttaactggagatattcttgcagaaaatgcttatttgattccacagtataaaaaagagattcagcagttggcggaagaagaaattcagcggcgtagtctcaacaacgattatttggctatgctgcttacgaaggaaaagacgtatcctgaaatggtgcagacgagttctcaggaaatagctagcttgattgattctgttaaaacggatgctttgtttactatcgatctccatgaagtatataaaaatcatccagatctacaaaaacaagtaggtgatttttcgggggaagatcgttcagaactattgaataatgctcgtcgtgaatacaatccaaccactatggatcaatctttagtttatttgttactcatcaatcatgtcacgcgacaagaacaggtcatcgcagagagtaaaagctcggatagtgatttcggtggctttggcggtgggtccagtagtgggggcggaatttccggaagctggtaatttttaagggctgtgacaaaaggttgtcatagctcttttttcgaacgcacggtaagcggtcgcttttgcagtaataagccgtaatttcttgcaactaatcacttctgtctcaaccactttgccttttgatctaaagacaaaggcggacttttgtgataaactttgtaaagttgctgaaaaaacatttttttcacggaaacatttcagcttatttttagaaaatgagggttgtacatgtatcattcgtatatttgggactttgacggcacattgtttgacagttacccaatcatgttagaggcgtttcttaaaacattgaaagacgctggatttgatcccgattcgagagaaatttatcgcatcttgaaagcatcgtcatcaaaacaagtagctgagaaatatcaattggatttcattgattttagcgctcgttttaaagcatatgaagcactagatgagcggctacccgtttcatttccgggaacgaaagaagctttacaagcagtagtagaccatggtggaaagaattatattttgacccatcgtgacgttgtttcaacgaaagaacttttaatgaaagaaaatcttgaccatttgatcgtagagatcgtgggaccggagaataattttccccgcaagccggacccaacgtctttgaattatttagtggaaaaatatcaattggacaaaacaacgactgtaatgatcggtgatcgtgcgatggatgtgctggctggacgaggggcaggggtgcaaacgatgttctatgatattgaaggattgctaactgatttggatgcagaccatgtcgttcattccatgaaagaaatcgaagaaattatcaagtcttgagcaatcaagactttttttgcgtacttctttttgaggtgattcattatggacaagtggttggattttgggaaaaaatattggcatttatccttgagcgcgctgttggtcattctttttctatttggtttgttttttaccccgaatgagccagaatggcccgaagcagaagaatcttcaccaattttcgaatcagagagtaggaaagagtcattggaccagatcgttgtagatatcaaaggagaaatccgaaatccgggtatttacaccttacctagtggagctcgactgtatgagctgatccaattagcgggcggggtcactgatgaaggaaatgaagaagtcatgaattttgcccaagaattgtcagatcaacaattagtaatcgttcctcatttagatgatccggtagtttacgctgacaacggagcagaaggaacacttgctcagaaccagatcgatttaaatacagcagatagcagccagttacaagagcttccaggcattggcgcgaaaaaggcagaggcaatcatcgcttaccgtgaagaaaagggtttttttaaaaccgtggaagaagtgaaagaagtttctggtattggccctaaaacttatgaggctttggaggggttgatcaaggtgcgatgaaaaataagagaaagaataagagaataagctcgcgattcagtggcttttctgtttcgttgttgtagggggtatagggagtataggggtataaggggtataaggtaagtagagaagtcatttttatttagtagagcgatcgggtgaaacaagtcagtatcgcgacgtattatgctaacaaaaacacactctgtcgcaggcggccggtggttgtaaaaattaatcttttgctcaaaaagagtcaatcgatacaactatatgttgtatcgaatgctaggggatctaaggaatttatcgtgtgaatacaaagtagaccttttctcactgtgtaatccatttgtttatttcagcaggaaaagatttgctaaaggtaagctataccgattacatgaaaaattcttcatttttcccaagataaaattaaaaataattttgaaaacaatttttttgcctaaacttttcctcagaatgctatcaatttcatttcttcctatttcctgatagtttataataacggacgtaataaattcgggaaaggagcgagcctatgctggaaaggtatatagaaaaatgcgtgattcgtcaagtctatctttgcgagcagttgtatgagaaggaaagcgtgcttattgaccgtttagccgaacagctggatgtctgtcctgcgaccattatcaatgacattgataaaattctgcttttactaaaagaacgcattgctaccgccactcacgagaagcatacatatcaagtggtttttactgccggatcttccttatcagagcttactcaaaccatttatcaaggatcctattttttacaagttctctatcaatttttgattggagagagaagttggcaaaaaatatcggaagaggtgtttatttcattaagcaaggtttataccattcggacagacttatggagattttttgaggaaatgggctatttaaatgaagagcaagaggaggtcgagatccccgagaaagacttccgctatcttctattggctgtaatgaactatttaggaaaacgtcctgaaaaaaatcagtcttttattgagcaggcttgtgaagaactgatccaattcgtggaacaacgtttttttctgcgttcttatcctgaagacgaacgtcaaatcattcatttagggatccacatcggattagcaagaagccgaatagctcctatttgttttgcatcaagggacaaggagatggcacgacagacaccgctatttcaattattacagcaaggtcttaaagaacttgtagtttctttgtgtagcaatgaggacgaagaattttacatctattcactttttaattcacgcaagtatcagtgcaataatctggagctgttgcaaagagattttgaagtcgtttatcgtaatcacattcatcgctgtccggagatgttggaactcacgcatttattacaaaaccgattaggaatctccgagaaaaatcatttgttgttcgaaaaagcgttactaccgtttcttcgttccgcttggggggacatgcagatctttcaaacggatcgtctattctttctctacccaagtgagagggaaatgtttgatcaaataatggagagccttgggttatgggcaaaccaaaaccagcagatgattcgatggaatgacaatctggttcgtaaattgacgattttactaagtttgcttcctgatgctgaaaaaactgaacatttggaagtgtatattgttgcaccttctgattttaaatacttgtattatcgccaacagttagaagaaatgttagatgagcactttaccataagcaatatgatctatcaccaattaactgatgtggtggatgatgtctttttttgtaccaaacgaatgattttatgtgatgcttctctttatcaagaaacacttcaaacgaaaaatactaaaatttatccggtgactttcaacactgtttcctctgttatcttagctatcaatcagacactatatcaacgagtcgaggaaatctttgcaacaaagagtaattgaaaagactgaaaaagataattattgatacaaagagagggattgcgcacagccgtgcgcaatccctctctttgaactaaagtagtgcaagcgaatggcactacttgggacagttccgcaatagaagtaacgttgagagctctaatgattttggggaagtttcttgctagaacgtgttggcctttttaatgagtaaagccgtaggttttgatttcttgttttttatgatagaccagatgagcctgatcaagtgccagcagagcttctttcatgtcttgaatataatcgtgggccatattcataccaaagtctgcacgaatgaccaatcgttggatgatttggtcgtctaaattggctggtaatggataagctggaacttgccaacctttcatgagtaaacggtctgctaagtcatacaacgtccattcccgttttgaatcgtctttcaatttgtagcagacgatcggaagttgagcgccatcattgatcatttcgaatagaccggttttttcgatttcttttgccaaataaagagcaactttatgggtcttgtcatgaatcgctttgtaaccatcaaaaccatagcgcacaaaattatagtattgtccgatcaactgagcagcactatgggagaagttgatggccatggttggtaactcaccgcctaaatagctgactttaaatacaagttcttgaggcaagtaagattgatcgcgccaaagtacccagcccacacccggataaacgagaccgtatttatgaccggacgtgttgattgatatgacatttggtaattgaaagtcccagacgagatccggttcagtaaaaggggtatagagaccaccagaagcagcatccacatgaatgtagactttatagtccgttgtttggttgtattgttcaacaagttcattcaatcctttaatgtcgtcatagcgtcctgtataggtgattcccagaatgccaacgatgccgatcgtatattcatcaacatagtccatcactttatcaagattgatcgacaaatggttttcatccatggggacttctctcatctcgatatcccagtagacacagaatttttcccaacaaacttgataaccgcttgaaatcactaaattaggtttatgagcatttagatcgagaccgagtttttccgcccgattacgccaagcaaatttcattgccatcccacctaacatacaggcttctgaagaaccaatggtagaagtgcccatgaatttttcttctttgcttgcatgccacaaatctgcaatgatattcacacagcgattttcaatttctgctgttcgtggatactcggatttgtcgatggcatttttttctagagtttgtgtcatcagcttaactgcttccggttccatgtaggtttgacagaatgtagctaaattcaaacgggcatttccttcatcaagtagctgatcttgtacgagctgataagccattctaggttcaacagattgtgaatttagtttgtatttcggtaaatcttctccttcacaaacagctccaaaaattggttccaaatagtctgcttcttcgcggttttcttttccatataacatgataattcctcctaatagataaaaaatacggttaatgtttgattgtatacttctcgttttgaacgatgtggtgttctcctcgagcgcttggataagtggcagggttcacatctcctgttttcatatgaaccggttcgtcgatttgagcttctttgccacgtttgtcatgaagttcatagagaatgaatggtaacaataaagtaacgatgaaactaatcaacaagatgacttggtaagttctgtcttcactggcaggaatcgaagaaggtgggaagaacgaaacgaataatgcgagcagcgacatgatgagccctaatcctgcgattattgtttttccgattgtttttcctggaacattataggtacgaggaagatcttttttcttaaaaagcagaacaaaatagcccaagaaaaacagcaaataaccaatcaaataaatcactactgtcagcgaaatagctaccaagaaagataagttgtttccaccgccgccaaacgttagaacagcaccccatattgaaacgatgattccttgaatcatgattagcggaacagggacgccatgtttgttgtgctttcgcaaaaaagtcggcagtaatcctcgttgtgccgctgcaaacatacctcttgatgggccaacgacccatgagctgacctcacccatgacaccaaaggcaatcattagtgcgattaacttcactagccaaccaagatgcggattgaagtgaagcaacaacgattcaaaggtttgaatcactccggcactgagagataattctttttgcggaatgaccgcagcaacagagaagccgccaatagcgtctaatgcaatggcaagaatgactagcaaaatcattgctagtggataatttttttgcggattttttagttcattaatgtgggaagcagaggcctccacacccatataagccaaaataaaagaaacaaataccacgagagtagaaacttttgaaaagtcagggataaatgctttttcactcagaggtatttgaataggatttccaccgatgaaataagctgctgcttgcacaaataagaggatagagggaatgacgatcccgataacaaatcctgcttttgcaatttttgctgttcttttggttccacctaactgagaaaacgttaagagccaaaaaataatcagcaaaccgatgtacttcatcaatggatcattgttgagggcgggaaaattcagcacataagaaagtgcccctaagatgaagtaaatcatcgtaacaaacccgacagtaatctgaaaccactgaaagaagatcgctgcaaagccaaaccgttcgcctaatgtttcactgacccaactaaatatcccaccgttctgccagccttttaccgtcgacatttctgccgcgcagagtgcaacaggcaaaaaccagaggatacctcctaataataagaagaaaaccaaatgaagttgtgacgtggcaaaagttgggtactcgtacacagtcaggaccatcgaggctgttagtgcgaaaaaaccaaataaaaataattttttctcgttcatcaaatcgcttctttctaagtctaatatcattttggcgctgttatctcggaggagaaagctgatgtatgcttctgttcattgtgtgtccacctcttttcttacaaaacgaagtataaaactttttgggtaagaaaatttccaagttttttctgaaaacaaaagtgaaaaagaaaaaaagctggaaataaaaaagaagcgtgtattttgctgttaaaaaaaagcaagagcactcgaaaggcgtattattttatgtacccctgaaaaactagaaataggcagatggtgttgctacaaaggttttatgaaaaatttgcgttaggcaagtgtttcaatgaaagggaggaatcggaagaagaaagagagaaaaggcgaaaaaactattatacctgggaagagtaaagtgaggatctttcgttccatccattagtagcatcaaatattagtagcatcaaagaaaataacaagcagttttattcccagtcccttaatcaaaaataatacccagcaggtaatggagtcattttgagaactgtttgactgacggtagcagtaggaaaaacaagcagaagtgaatggagaaaaagacactaaaattcatcagcccctagattaatcagtgggggtatagtatattataaaaaattgtgtactattatttcgcaatcggaaaaatagaaaaaggaggtacgcagatgacaagcgatctgaataaaaagaatcaatgggttaattctcaaaaccgatcgatagaaggaaataaacgaatcccttgggatcagtattttatggctcaagctgttttactttctcttagaagtacatgctctcggttagaggtgggggcgacactagtcaaggaccgacggattattgccggcggctacaatggctcagttagtggagacgttcattgtattgatgaaggctgctatgtggttgacggacattgtatccgcacgatccatgcagaaatgaacgcattactgcaatgcgccaagctaggtgtttcaaccgacaatgccgagatttatgtgacacactttccatgtttgccttgtacgaaggcgattttgcaggcaggcgtcaagaaaattcattatctgaatgactaccgcaataatcaatatgctctagatttgattcaacaagttggtgctaccgtccaccaagttgaacttgatccagcatattttgaaaaattatcttttggtgccttgaatggggctacacatacaaacatgccgtgaccatttcctttttgttggagtgatcattggttgctgggtaacaggtttgtatttgaaatctgttcttttatttattatcgcaagttatcttcttctgggactactgataaaaaaacaagttgctttattggcactttgttgtcttggcagtgtattgatagggggacgtatggtcagttttcaaaatcctcagttggaagaaggatcgttaactgctgaggttcttatctatcctgatacaatcaaagtcaatggtgatttagtgacatttgaagggaaactgcctgaaggtaaagtgatggggcgttatcaagtttcttctctttccgaaaaagaccaatggctcagccgacaaaattggcagaaatcactaagagtacatggaaatttcaagatagcagagccaatccgaaacaaacatgcctttgattactcattttatttggctagcaggaacttcttaggcacattgacgattactgagattctcgcaagcaaacaaactgccgggatttcttcgatccacaggtggcgagcagctgcagtgactcacgtgaagcagtttttccctgagaagttggcatcttatataaacgcattgttatttgggtataaagatcatgagtttcaagagatccgtcaattattcagtagcagtggcttgctgcacttttttactgtgtccggactgcatgtgtctttctttttctactggttagaacgaggtctgagacgaggaaagctcaccagagaggagatgctgcttcctcttttgccaattatcctgatagccgccattttatttggtggttctatcagcgtgattcgagctgttctcgcttatgggatgaccgttcttttgcgactgttttcctgtcacctttcagcctgtgatcgttacggtatcgtgctttttctaacacttatgatcgacccaaaagtttttctgcaaacgtccgggcagctatgttttttgatgacttttttattgctcatgcaaagaaacgtacaggtttcctcagtgatccgttctcagtttttgccgttattggcagcgccgctgctgatgcacttattctatgaatttcctttgttgggtgggatttttactcttcttttgcttccgttgtttcaacgttttatcttacctagctgttttgctctttttgccgtaagtcttttgataccaaaaataccctatctggatagttggagtgaaacactttttcatggaatagaggaaatcgtcttttttcttggaagatttgccctcacgactggaaggattcccttagaacttgctattttctgtagtcttcttggtttatttttttatcagcggcatcagttctttttttgtttcttagtcagtttgtttttaccgctacttttacagcgtctttttgtccctgctgccgttacatttgtcgatgttgggcaaggtgatagttttgtcttacaaacagcctttaaccgggaagtgtatgtgattgataccggcggcagtttatcttttcctaaagaggcgtggcagcaacgcgcgtatcaagaaaatgcacacgcctcattgattccatttttaaaaggcgagggagtcaggcaaatcgatgggctttttttgactcatggagacacggaccatctaggtgatgcattggcattaatgacagcaatccctatcaaaaaaatatacctagttcctggaagtgaacaccatcctcagattgccgcgttaatcaagcagcttccgcaaggaactgttcactggacaaaagtgggtgaaaccattggtcgcgaccttgctatcactgttttagctcctgagtctggacaaggtgaaaatgaagattctttagttttgaaggctgaaattgagaagtggcgctttttatttaccggtgatttagatcaaaaaggggaagaaaagttgattcaactgtaccctcatctccaggcagaagtggtaaagctagggcatcatggcagtcgtacctcgacttctgctcgttttatcgagagcctttcacccaaaatcggcatcatctcttgtggcaaagacaatcgctatggacatccacattctgaagttttggaagtgatggaaggaagaagcatcttgagaacagatcagcaggggatgatccgcttcagctggtcaaattggcatcgtgtccaacagctagaaacatggctagactatcgattagaatgatgataggatggaaaagaaagcgggggaatctatggaactgcaaaaagcgttgcaagagattcgaacgaaatctctgcaacctatctatttagtgacaggcacagaaaaatttttacaagaacaagtacgtcaagcatttttaacgcgttttgaagtttcaaaagatgacttgaattttgcttcttttgatatggaaagagagcctttggatttggtgattcaagaagcgcaatcgttgccgtttttcggtgatcagcgattgatctttgtggagcggcctttttttctaacagcagaaaaaaaagccaatgttccagaacatgaccttgatgattttttgctgtatttaaaaaatccaatggacacggctgttttggtgatttttgccgaatatgataagctggatgaacgaaagaaaatcacgaagcagttgaaaaaagcagggatcatcatcgatgtggcaccaatgaaagaagcggatgttcgtcggtacttgcaacagacattgacaaacgatggtattgaaatgactagagaagcttttgaactgtttctgcggttgactgatctccatttatcaaaagcgatgcaggagctgcaaaaattacgcttgtatgcaggaaaagatgcgaagatcacaaaagaaatcgttcagcaattgattccaaaaactttagaacacaatgtttttgaattgactaatgatgtgttacaaggaaaagtagcggatgcctggcggttgtatgatgatttgttgttacaaggggaagagaccattaaaatcaatgcaattttgattggacaagtacgcttgcttttacaagcgtcgattctgatgaaggtcggctatcaacaggcaaatattgctgagacactaaaagtccatccctatcgggtcaagttagcaatgcagcaggcaagaaagttcaatgaaaagcaattagcagccctttatcatgaattgattgagaatgattatttggtgaaaagtggtcaaatcgataaagaatttctgtttcaattgttcgttttaaagcatggtaaaagacaagggtaaaagaaagccgaagcaatcatttgattgcttcggctttaatttgcttatttcgcaatttttttacttaaacgagatttgtcacgactagctttgttcttgtggatcaatcctttagtctcagccatatcgattgctttaacagcatctttatataacgcatctacgttatcagcaccagcttcaacagctagatcaaattttttgattgctgtacgcattgtgcttacttgagatgaattcttagcattagccgcttcgcttgtgcgaacacgtttgattgcagattcaatgtttggcatgtatttcacctccaaaaataagttcttatacgtttaaaacgtataaatcaacactagtcattatacctaatgcaagtttcatttgcaataaaagttgtaaagaaattttacttaacacaaaaaaaggtgcttttgccagctattttttcttgttctatattattattttaatcctttacatattttttaatgaatacttacaaaaagtttacactttgttcactttctatgctatgattacttcggaatttttaaatgaggtgtataaatgtgaatatggctttagttataaccatcgtgctctcgttaggcgttattttcgtcaatgggtggacggatgctccaaatgcaattgccaccgcagtctctacgagggtcctacgtccaaatgtcgctattggaatggcggtagtgatgaatttccttggggtcttagtgatgacgtatttcaatgcgcaagttgctgaaaccatcagtaacattgtcagctttgatactgctggcggctttcatgttgcacaaattgctttagctgctgcacttttttcaatcgtcgtctggacggttgcggcttggtacttcgggattccaaccagtgaatcccatgcattgattgctggacttacaggagcagcaatggcactgggcggattacatgcagtaaacggacaagaatgggtcaaagtactgatagggctggtggtctcaacattgatggggttcattggtgggtttatcatcaccaaattgatcgtttggctcttccggggaacttctcgtcgtaaagcaaataaagtttttacgatcgggcaagcggtcgcagctggagcaaacgcttttttgcatggcgcacaagacggtcaaaagtttatgggggtctttatgctaggtctttactacaataaccttgtagaaaaaagcggcaacggctttacgatccctttgtgggtaatggcgttatgttctcttactatgggaatcggaacctctgtcggtgggatgaaaatcattaaatctgtcggcatggacatggtcaaactggataaatatcaaggtttttcggctgacttaacagcggcaatctgcttgttcttatcttccgtgtttgggattcccgtttcgacgacacatacaaaaacaactgccatcatgggtgttggcgcatcacgtcgcttttccagcgttgactggcgcatcgtgaaagaaatgatttatgcttggatcttgactttcccaggctgtggcttgattgcctatgtaatggtaaaagtattacttgtgattttgtaaggagagagaagaatggcacgaaaaaaaagttttgattattttgcagcgatggagcagctagcaaccaatggtcatttagcggcaaaacgtttctcagttctgataaatgattattcagaagcagcgttaactgaagcagcagcagaaattcacgcattagaaaaagaaggcgatcaagtgatcgcagaattgaccaatgaattatatgattcttttatcacaccgatcgatcgtgaagatattttgattatttctgaacgcttggacgatattttagatggcatcatgggattgacttatttatttgaaaatcttgtgatcaagtcattacgtccggaaacagctgatttcgctgtcatgatcgaacaggccacacaaggtgtgcagacggcattaaaagagtttcctaagttcaaaaattcaaagacgctacgacaaatgatcaatgatgtcaatcgtatcgagtctgaagcggaccttttgtactctaaattgaaaaaggcccttttcactgatgaaaaagatgtcttagaaatcattaaatggaaagacatttatgaccgctttgaaacaatcatcaacgacacagaaggtgctgtcgatattattgacggcatggtcatcaaaaatacgtaatttagctaaaaacactgcgatgtccaaaaggacatcgcagtgtttttattataaagatactaaccagtaaacgatcaaaaccgcaccaagtacgatacgataccaaccaaagaaagtgaaatcgtttcgtttgatataattcatcaagaagcggatggctaacacggaaacgataaaggaaacgatcgttccagttaataagataactgttccttgcaagtcaaaagcatttccaactttaagaaatttgtatattttccatatacttgcaccgaacatggtagggatacctaagaagaatgaaaattctgttgcgacaaagcgggaggcaccaatcatgattcctccaagaatcgtagcgccagagcgtgatgttccgggaatcaatgctaatacttgaaacatcccgacaattagtgctgctttataagtgaacttgttcaaatcggtacattttggttctttgtttttgtttcttttctcaacgacgatgaagccgatcccgtagatgatcagaacgatcgaaacagagaggaaattatagaagtgagcgtctaaccaatcgtccagtggcaaaccaatgatgactgatggtaagacagcaatgatcactttcgaccagagtgtccaagtgtctctcttttccaatgcatttttggtgggtgaaaaagggtttaatttatggaaatagaggtaaacaaccgccagaatcgctcctaactggatcacgacgttgaacatcgccataaattccgggcttactttcaacccaataaattcatcagcaaggatcaagtgaccggtactactgatgggaagccattcggtaatgccttcaatgatcccgaaaaggatggctttaataaaattcgcaaaaaacatttgttcagtcctttcttgtatggtgaaatacattacatagtatacctgttctaggaaaaaataccaaacacttcctaaaaaaagagcagtttttcttgctgaaaaaatcgtcaagccgaggatcttttcagcaaaaaactactcttacttttgttgattcattattgcaagaaaatcaagcgaggagatcttgtgaaagggcaagtcctttcttgatatattcagtgttgcccacttccgcaattgtgaattcaccattttcataaatcagtcgggtaaccgaaccattatcgatgtccacacgcacgttgttttcgttattgatcaaatgcagcaagaaggcgatcgttagaccatgggacacaactaacgcattgccgccgccttttttctcaacccgatacgcgatgtcttcaaagccggttttgacccgttcagtcaattcatcgaaggattcggcccaattcgctgtgtccgcacgatgaatcgcattggcaacagcctcaaagctgacatggctagcaatcatattgtcataatcagggaaatccaacacacgaggaatgacgccccacatttctgcatcataagccccttctaaagacccaaaacaccattctctgattcgtttatcaatatgataaggaatctgaggcccacgtaaatgctcgcccaagatcaagcgcatggtttcgatagcacgaccactatcactggatactgcttccacaaaatcgatctcccggagaccaagcccaagataatggattccttgttcacctgtgcgggtcaatggagtatcacaccatccctgaacgcgctgtaatgtattgaacattgtcttaccgtgtcgcacgacatataattctgttcttgccatatcgtttcctccttttacatttatctaaaaaatggatttgtccgtttttcgttttcaatcgtcgttggctcaccatgccctggataaacagttaattggttgggcagaataaacaactcagattggatactcgttaataattgttccaaattaccagttggtagatccgtacgtccaatactgcctttaaaaagggcatctcctgaaacgacaaaatcatcaaaaataaagctgacactcccaatggaatgtcccggagttgccacaacgcgaaaagagatgccgtcaatttgataatcttttaacgccaattcatgctctgcaggacgtgcagtaataccgcctaagtcaggatggcgaccagaaagattttttagaggatctcctaaccaatcttgttctaatggactgacataaacggggatactgtaatagtctcttaagtgatccactgcaccgatatggtcataatgagtatgggtcaataagattgcactaggctttgcttctgttttttcgatttcagcaatgattcgttcagcctctgctcccggatcaatgattaataaatgcccatcttgccaaaccaagtaacaattctcttgaacagggccggtgactaagccaatgattttcatattttaacctcctctgtttcttcttttagtatagcctaaagtattcaaggaaacaaaaaaagctttttaaagattcacagttttgctctttatttaggaaaaagcaagagagcgtaaaatggctcttcttgcgctggtggaagaaaccaaagagaaaatgagattaaaaaaatctgcaaaaaacggcagtttgattaaaaatagggtcgtttttaaaaaactatcccgaaaaattttctaagaaacctccgtaaaaaaaatacactgttatactgtaattaatttaaaaaaccttaattatggaaatagtggaggcagtaacatgaataagaaagtatgtctagttttatgctcattcttttgcagcttgttactcgcaagctgtgggcaagaaaatcaagcaatcaaaacgagcgaacctacgacagctactgcgaccaagctcagctccacaaatgccgagaatgtcgacttgatgctgattcaagaagaaagcagtcaatttccgcaaagccaaggtgtctatgatctgcaaggagaagaattgaccatcgtcaaacaatacttgcctatgacagaaagtagcagtgatgaaacgttgagtggttcggcactcaaaaaaagaaatgaaacgatccaagcagactttgaaaaaaattttgcttccgcgaatcttcgcttaaaagatgatccctttgaaatctacgagacgaccttacatggggcttcgttttccatcgatggaaaatatttatttttacgagcccatgggttggaattaaaatttcagtatgatgaagcaaccaatcgtgcctacgatgagaacaatgtgcgctatgaagttcaagtggatcagtgacggatactaatgagaaatgcctgaaaatcagaacagtataagaagtttaagagaaatagatgccacaagaaagtgacaagtcgattgagacaactttcgattgcgatgatgccaagaattaaaacacatcattaggcaagaagagaggttgtttttgatatgctgtaaccattgtaggcattttttaagaaaatgtgaaaaagactgcaaatcctgcaggctttttttgttcgctttaaaatcagtgaagcttccgatataatagctccgagaaggtgatcacgtgtataaaggaaaaattgctgtccgaaaaatcgttgaatttattttgcgccgtggtgatatcgatagtcgcaaagtcagtaaccatactgctcaagaaggcgctcgtatccatcgacgattgcaaaaagaagccggcgatgcctatcaaaaggaagtctttttcaaaatagaaagcgagatcgaaaaggacaagttaactatcgaaggacgtgcagacggcttattctatgacgaagagaaacaatgttgggtaatcgatgagatcaaaacgtcagaaccctactttgaagatcttcctgaggatcaaatcgatttattttttgctcaagggatggtttatgcttatatttaccttcaagaagaaaagttgacggaaattgaagtccaactaacctattaccagacgacggagcagctgatcacccgcgtccgtcgccattttacagtggaagaacttactgaattttatacccacttgatcaatgaatatcataaatggctggtttttcaggaaaattggcgccgtgttagaaatacttcactacaactgttaaaatttcctttcgaaacgtatcgaaaagggcaacgggaattggctgctgccgcttataagacgttaaaaaacggcaagcgattgtttgctgaagcgccaacaggtactggaaaaaccatatcgactctttttcctgcactaaaagtattaggagaaggggatggcgatcgtttgttttatttgacggcaaaaacgatcactcgccaagtagctgaagatgctttaagcaagttggcggataacggcagtgaaacaaaaagtgtgaccctcactgccaaggataagatttgctttttagatgaacggaattgtacgccggaacattgcccatatgcgaatggctattataaccgaatcaatgaagcgctatgggatctgcttcatcatgaaaatcaaatcacacgagaagtgattgaaacgtatggaaaaaagcataccgtctgtcccttcgaactttcgctggatgtcagtgtgttttgtgatgtcattattggtgattataactatctgtttgacccgactgtttatctccgacgcttttttgaggaaccagaagaagattactttttcttgatcgatgaagcccataatctcgtcaatcgttcaaaagagatgtattcagcagagattcgtcgcagcacgtttaaagatcttagaaagcaattgccaatggatcaacaaaaacttcgtcgagcattgaataaagtggagaaagaattctctgcgattgaaaaaatcgctgagacggatcattgggagtaccatcatcaaaaagaaccccatgaaacgatgaacaagcaattagcaaagctagctgagcttatgaaagaatggctgccagctaaccctgaacatacggctcaggaagcggtgctgcaaagttattttgaagtgaatcactttttgaaaattgctgaattctatgacgatcattatgaaacaacagtagaggtcactcgatatgagctgactcttcgtcaattttgcattgaaccggctccttttctacagcaagtgttagacaaaggaaaagccagcttgttgttttcagccagtttcacgcctcttgattattaccaggaagtgctgggaggcggagaaaaagcattacgctatagactgccaagtccatttgatcctgcaaatcaaaaaatcctgatcgcaaattacatccagacgacttaccggcaacggacagccagtctgccagcgatcgtagatgccctttatcgaatggttcacgcaaagtcaggcaattatatggttttctttccttcttaccagtatttggacgaagtagcagaagcatttcatcacgcgtatccgactattaagatgctcgtacaggatacagctatgaatgaaacggaacgagaaaattttttagcggaattcaaatacgacacggcggacgctgaagaaaaaacttcgttgataggattttgcgtattgggcggaattttttcggaaggcatcgacttgaagggaactcgtctgatcggaacggcgattgttggtgtcggattgccgcaaatcaatcacgaacaagaactgattcgggactattatgaagaaaaaaaacatgctggttttgcctatgcctatcggctgcctggaatgaacaaagttctgcaagcagcgggacgtgtcattcgtgattctagggatcaaggcgtgatcctgttgctggatcagcgttttcatacaacggcttaccagcaactgtttccattacactggcaacacgcccaaacctgctttcgaccagagcagattagcaaagcaatggaccatttctggcaaaaacaaaaagactctcagcaccgatcgtagaccgtacatgcggtttgcgatcggtacagagagaagtcaacgataatttgtgaattgtaaatcgatcggtaattcaagcttgcgcagcagctggatgactttttgtaaatcgtcacggcttttaccagtgacacgaatctgattgtcttgaatctgcgttttaactttcaattttgcatttttgatggcggtcgtaatttttttcgcctgttctttatcaatgccgttgatcaattctgcagtctgacgggctttggcgccaagtgcatgttcagtctgtgagaattggatattttttgtcggaacacttcgtttgatgagtttgctgcttaacacatctttgatttgttcaagtttgaattcatcgtctcccacgattgttaatttattgccatccattttaatttcaactgtcgaacctttaaagtcaaatcgattctttaattctttttctgctagttggatggcattttttacttcttctgtattgatttcagatacaacatcgaaacttgcttcttttgccacaaaagatcatcctttctatttttctttaattttaccatgagtcagaaaaaagaggggagagaaactaaatttttgcaaataatagtttcaattttagacacaaactgctattctttggaaggagattttttgtgaaggagaaatggcattgtgagtaaattatggacgaaacatcagcagtcggaaagactgaaaaaaatcggggttattttgttgtcaggattgaccgcagcgatcgcgttgaatttctttttgattcctgcaaaagtactttctgcagggatgaatggtgttgcccagttgatcgtagcagtcgggtgggaacaattcggcttgcatcttagtaccggtctctttattttgcttttgaatgtgccaatctttattttaggctttatcaaactaggcaaagcttccacttggatgagttttattaacgttgtagtggtctctttaataacgatgattttgcctcaaggagaaatcacaaacaatatcctcgtgaattcgttgattggcggcgtattacttggtgttggagtcgcttattcgttaaaaatgggtttcacaacgggaggaatggacatcctctcattgattttatcaaaaacgacaggtaagactgtcggcaaatatatgtttatgcttaatggcattattgttatgctgtcagggtttattttctcatgggagagcgccttgtacacgatcatttccatttttgctatgagttatgtggtggatatgcttcatacaagccatcaaaaagttacggcattgatcatcaccaccaaagcggaatctgtcggcaagaatatttcaaaacatgtgtttcgcggtatgacattgttgccatctgtaggagggtattctggtgttcctggaaatatgattatgatggtagttactcgttatgaaatctatgatttggaacaagctgttttagaagcggatgagaatgcatttatcaactttgttccgactcaatcgatcacaggacgttttgcaacagacgatgaacagcgtacattcaaaacaaccggagtctttccagaattgaaagttaacaaaaagaatcgtccctaaggaaaacgaaagcaaaagtgtcatttacaaagggattaaaacaagttatgatttgaacagatcatcaaaggaggtttcgactatgccttatactgaagcagaaagcgaagcaatcaaagaacgtgtcttagcagcgttagaaacagttattgacccagaattagggattgacattgtcaatcttggtttaatatatgaaatcgaatttgacggggaaacaggcgatacagttattaaaatgacattgaccactatgggttgcccattagccgacgttttgaccgaacaaattcacgaagcactaagcgatattccagaagtcaaaaatccagaagtaaaattagtctggtatcccgcttggacgaccgataaaatgagccgttatgcacggatcgcgttggggattcgctaggggatttgctgattccaatgcagcggctgttagtttcgtaagtcgtttgaaatagtatggatgtataagtacattttattctctaaataatccgtagaaattttggaactcttttattaacttttaagataagttagtaaaggagttttttagttaaacaattttttattagtatctgttgcattttcaataaggaaacgcgaccccatacctctgttaaacaggaagctttatagtaaaagaaaagtgagtctgaatttagcgaaatgaacgattttcgtgcgacgactgcttgtcgtttcagagaccatttttgtaaaaaatgataaaataatgatcgataactaaagaaaaggaatccggcctatgctattaacaaagaaaaaactctctcgcctagcggctccctataatgaaggagatatgagtattggttttgccgaatcacaaagtatagaaagtataagcagcaaaacgattttacttgtgaatgatcgccaagtaatcattttatttttgaacttttttcaaacaaaagtcattgatcacatggcttacaccagaaaagatctagtcaatgagcaattaagtcaagggttcaatgggttagacgttgtttggcgttttacagtccaaaataaaaaatggcgttttcgcatactaaagaaaatagtcacactaggaaaaatgcaaagagaattgatcgagcggctctaaaagagggtacgtacctaaattgtaaaagaattttgagcggtaatttgatgaagactgattgtctttttttcaaggatctcagcgaatagagaattgctacaaataaaataatgacgaaacctaaaacggcaattgcattttgcaaactagaaaggtaaactattttcaatgaagaaaggagacgaacaatgttaacgactaaatttggtgaatttacctacgacaatccctttatgaatgcttccggcgttcactgtatgaccactacggatttggaggaacttgcagcatcagaagccggttcttttgttacaaaaagtgccactttagcaccgcgagaaggaaatcccgaaccgagatatgtggatctcgctttaggaagtatcaattcaatgggattaccaaataaaggcttagactattatttgaattttgctttagagaaacaagaagcaatcgctcctgaagcacctttcttcttttctgttgcaggcatgagtgttgaagaaaatattgaacttctaagaaagattgaagctagcaactttcgtggtatcacagagttgaatctttcttgcccgaatgtcccaggaaagccacaagttgcttatgattttccattgacagaacaaattttagagcaagtttttagtttcttcacgaagcctttaggcgtgaaattaccgccttattttgacctggcgcactttgatcaaatggctgaaattttgaataaattccctttaacatacatcaattctatcaatagtattggtaatggtctatatatagacccagaaacagaagtagtagtgatcaagcctaaagaaggctttggcggtatcggtggcgagtatgtcaaaccaacagcactcgccaatgttcgggctttcgcgacccgactaaaaccagaaatcaatgtaatcggaactggcggcattcgttctggacaagatgcatttgagcatttgttatgcggagcgacgatgttacaaatcggaacggaattacaaaaagagggaccagcgatttttgcccgtctgaaaaaagaattgacagaaattatgactgccaaaggctacacatcgatcgatgaattccgcggtaaacttcgctcattgtagccgattagcaaattgctactgaaggaggaatggcatgatccagtttagaaaagcgacgctctctgatttgccggaaatgatggctctctttgagatgggcatacaatccttaaaaaaacagggctcacctcaatggcaaaatggctatggtcccactcgtgaaaaaatcaaagaagatatcaatcaacaagaaagttatctcttgttatatgacgatcaaattgctgcttctgccgctttagtcaaaggggtcgatcccgtttatactgcgataatcgaaggtagttggtcaggggatgggccttatgcatcaatccatcgtgtcgtagtcagtgaccattttagaggcaaacaattgagtgcacatttactaaaagcgctagaggaagaagcgttagcaaaagggatccatgatttacggattgatacctatcaagcaaatattggaatgcagaaagtgatcgaaacctgtggttatcaatatcgtgggcaagttgttttccctattccacacggtgaacgactggcctatcagaaattaatctaattgattgggtgaatatagtaatatctgctgtaattgccagaccataagcggaatggctgagccatactaattccttaattcccttagcgggttcaggtcgaatttgggcagcgtgtttagctcataaataagatgttttttgaaagattgatcatgacggaaagaaagatagcaagttttgcgtagctttattatgcagggcttgctatctttttgtttatttttattccgaatagacgaaattaattaaatgtataaaaatagagagttatcactttattttaatattgtgcatatggtaaagttgatttgagtaaacaatgtaggagaatccaatgaaaaaaagaaaaagtatgcgtaaggcgttggcaatgctagcggctctattgatcacccttggacaaggggtgcctacggttgaagcattgactgtcttagagaataacgcagaatcagcaatagtcgattcaggctcatcaatctcagacgaatcaaatgaatcctcagaaccatctgaagaccgaacggccgattctttcgaaaccgcatcaagcagtcaaagtatggaaacagaagaatccattgatgaaagtcattctactgaaccatcgtcttctagtgaaacgactgaggaaacaagtgaaagtacaagtacgtctgaaagtgagacatcttcctcaagtagcagtgcgtcgacaacggattcaactaaggattcaacaacgcctagtatgtcttctactaccgaaaggccatcaggaaccagtcattcatcaaagccaaatgatacgacagcaaattccacccaaagttcttcggaaccaaagacatccaacacaggttcttcagtcagccaattgccgccatccaatcagcctatagcagattcttcccagacagttgatttatcagataaattggttaccaccccaactgattctaatttgaatggctatatcttgccgttgttgaatcagttagcaaatgaacgatccgcagcgctgatttcagaagcgttgaatcaactaggcaaaccatatgaaaaagatgcgcagggtactggatttaataatctttcgttgcctattgctgtttatcatggcgtttttgatataaaagggatcgaaacttataatcagctcagccgggtaggaaagcaaacatcacttgaaaaagccgtacctggagatcttttgttttggaaagacggtcagcaattagtcaaagcagcaatttaccttggacaggataaactgatcatggcagatcaaccccaagcggaacaaatagtcaaggaagaaaaagcggcgacagaaaacaatggcgtacgcatttatactattactgataaacagaatagtactgcggaaacaaaacaattgatccaagaagatcaggtaaacaaaccagatgtagtagttcatttttctgactcgcaaaaagtaacacctcatggacaatcactaatcgctaagtatgcggctagctatgattttcgcaagaatccgcaaacagaagcatttgttgcggcaattgcagaagatgctcgggaactaggcttaacttatggtgtgtatgcgtcggttatgattggacaggcaattttggaaagcggatctggtcagagtggccttgcttctcctccgtattataatttgtttggaatcaaaggaacttccggtagtcgttccgtttctatgatgacagctgaggataatgggaccggagaattttatacgatccaagctgcttttcgtgcctatacaggatacaaggagtcgttaaaggattatgttcatttactgcggacaggaattagtgggaatgctgatttttacaaaaaggtttggcgttctgaagcaaaaaactacctgcaagcgactgaatatttaaaggggcgttatgcaacggatacgagctacaacaataaactgaattcattgattgctgtctatgaattaacgaaatatgatgaagccaaagctggcagcggcgttgtcctacaatcaaaagaagcgattcccaaagagtatcggcagctgttggtgtttcctgattataacggtgtaaattataatacctcaggttcttatccagtcggacaatgtacttggtatgcttacaatcgggtcaagcaattgggcggcagtgtggatgaatatatggggaatggtggagaatggggagcaaccgcaaaacgtttaggctataaaacggcggctactccaaaagcaggctatctgataagttttagcccaggcactgctggctctagcacacaatatggacatgtcgcctttgtggaagcggttggcaaagatggcattttaatatcagagggcaacgttattgatggcaaaacgatttcttatcgaatcattcccaatgagcttgcttattcgcaaagtgtcagttatattgccccaaaataaaatttcgaccaaaaactctagcgaatcgtaaaaattcggttgtcaacttctgccacaattgctaagatagagcacgtaaaggacggtgccgaatgaaaaaacgtatcaaaaagaaaaaagcctataaaaagtatatccaagacatattcacaggatatgaagaaatgttggaaaatcctgagctcaaggagagatcctttagttatttgaaagaagaaacagtcttgagacgtgatgaaaacgatcagattcgttttcggactcgggacattgattaaactgcctattttaggcagtttttctttttcaaaaataattgaaagtatttcagaaaaacacttgctctttcatacgcttaatgataaagtagtgaacgttggcaaaacacgccgacagtcaaaacctttcaaaaaaacttttttaaaaaagggcttgaccaaaacggaaacagatgatattataacgaagtcgcaaatttaaaaaatcaatttgatgctgatgcagcaacaaaaaagattgaaaaaagttgttgacaaataacaattcatttgttattctaatggagtcgctgatgacgcacaggaagttgttgaataaacactttcgaaaaaaacttttaaaaaagagttgacattcacttgtcggtctgatatgatttaaaagttgctaacgcagcgcagtagacctttgaaaactgaacaaagcaagcaaacgaaccaatgtgtagggcgcttcattatatgaagcaaaatacatgcaagcaatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaatagtacggaagactacacatcgtttgcctttgttcagttttgagaggtttactctcaaaatagtttgttcattgaaaactggatatcgaagaaaatcaaaacaagtaacacacaccgagttgacaagttaaagagttttttaataagttcaacgcttattttcttgagcaaccttctatcgctagaagaagtactcaccgaccgtaaggtcaaaggttaagtgaataagggcgcacggtggatgccttggcactaggagccgatgaaggacgggactaacaccgatatgctttggggagctgtaagtaagctatgatccagagatttccgaatgggggaacccagcatcttttataggatgttacacagttgtgaatacatagcagctgtgaggtagacgcagagaactgaaacatctaagtacctgcaggaagagaaagaaaattcgattccctgagtagcggcgagcgaaacgggaaaagcccaaaccaacaagcttgcttgttggggttgtaggactccgatatggtagttgaaacagatagtcgaaatacttggaaaagtatgtcaaagagggtaaaaaccccgtagatgaaatctggctcacatctaggaggatcctgagtacggcggaacacgaggaattccgtcggaatccgggaggaccatctcccaaggctaaatactccctagtgaccgatagtgaaccagtaccgtgagggaaaggtgaaaagcaccccggaaggggagtgaaatagatcctgaaaccgtgtgcctacaacaagttagagcccgttaatgggtgatagcgtgccttttgtagaatgaaccggcgagttacgatagcatgcgaggttaagttgaagagacggagccgcagcgaaagcgagtctgaatagggcgaatgagtatgttgtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtccccaaataactattaagtggaaaaggatgtggggttgcacagacaactaggatgttggcttagaagcagccaccatttaaagagtgcgtaatagctcactagtcgagtgaccctgcgccgaaaatgtaccggggctaaatagtttaccgaagctgtggagtgcaccataaggtgcattggtaggagagcgttctaagggcgttgaaggtagatcgtgaggactactggagcgcttagaagtgagaatgccggtatgagtagcgaaagacaggtgagaatcctgtccaccgtatgactaaggtttcctggggaaggctcgtccgcccagggttagtcgggacctaagccgaggccgacaggcgtaggcgatggacaacaggttgatattcctgtacccgttgtttttgtttgagcaatggagggacgcaggaggctaagaagtgcagactgatggatatgtctgttcaagcagtgagtcttagtgggagtcaaatgcttctactttcaaggacaagctgtgatgaggagggaaataatagtaccgaagcttctgatgtcacactgccaagaaaagcttctagtgagaaaacaatggcccgtaccgcaaaccgacacaggtagtcgaggagagcatcctaaggtgagcgagagaactctcgttaaggaactcggcaaaatgaccccgtaacttcgggagaaggggtgctgctctaacgagcagccgcagtgaataggcccaagcgactgtttatcaaaaacacaggtctctgcaaaatcgaaagatgacgtataggggctgacgcctgcccggtgctggaaggttaagaggagtgcttagcgtaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagagatcgggacgccagtttcgatggaggcaatggtgggatactacccttgcgttatggccactctaacccgcagcccttatcgggctgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagagctacaactcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgtctcgccagaggcatcgctgggtagctatgtagggaagggataaacgctgaaagcatctaagtgtgaagcccacctcaagatgagatttcccatttctttaagaaagtaagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgcaagttaaccttatatcaaatatttgatataaggtttttttttgtttaaaagtaacgggatcagcaatgagtctgccaaaaacatggtgcaaaaaatttaggtgacttaaaataactttttttgcgaaaaaatgatacactgtttatgaagagtttttaggagggatagtatgactgaggagcttaaaaaagaacaggatccagtagacaatgaacgtaacgaaacgacgtcggcagttccatttacagaaatcaaagaagtcgcttcaaaaaatattggtcagatgcttcaagacctgcaagcgttcgaaacagcgattgaaaaggaagacattccggagatttatcgaatctacaatggccgcctgcacaaagaattgaaagaaacatccaatcaaaatcatgaaatcgatgagttgctggcgcggaaaatccatgacagttttgtcgctacttttccattcatgatacatgccgatcgaatttcacctacggttcattattataaaataggtgaatactaccatgaacgtccgacaattggcattgatgccagtgttccagaaatctttgtgattcctgctattgatgatgagtggcgtaaatttcaacgcggcaatcgtgatatgctgacagccattgaacaacagatggataatttagacgccaaagccattgcggctcaatccgagattcaaaaactgcaagaggagatcgatcgcattaagcgtagtgaaaacgagttgtcagaatcaaaaggattttttaatcgcggaaaaatcgatgaggaattagaagcattagtccaagaacgaaaaaaagtagaagcgaaacaaaaagaatggtctcgctattcccaaaacgaacaagacgtgcttcttgaaaaagaacgattaatgcagcaatatcacgccttgcgcttaaaaaaggcaatcgtcgaaaaagaatttcgtcaaatcgatcactattttggttcgttgcaagagatgaacgaacgattgcaagctttcttaatgagctatctaggagaggagtcgatcgcagatgaataatgaggaagaaaaaacgcccctaatgaaagaacaaacagaagatgggattcgcgaaacagctacgtcaaagagcgaactggaaataatggaaacaaatgagtgggcaaccgccgctgatgaactaaaaacagttgaaatagaatcggatgagcttgaagcaacggcaattgatcaggaagacttgtaccaacaatctgctgaagaaggccatagcgaaaggctaatcattgactctacagagtctgcagagcttgaaatacctgaagcacctggagaacctggagaacctggagaacctggagaacctggagaaccttatgatgaatactatgaaacgaaagaaagcgatcaccaaagaattgaaagcttgattgaacaagcagaaattgaattagcagatttgcgcttacgcaaagccattatggaagctgattttgatgaattatgtcatcactaccaaacattgatcattggcaaccaggatatttcaattatcgcaaaaaagacgttactggaatactatgcttatgaattcttgaaacccttgcgatcgattggattgatgccaaccgacaactacgatgtttggaaaacaaagcacttcttggtgaagtttcaattgaatgaggaaaaagcaatggatttatattttaaattaaatccgatcaattctcaatatgaatcacagtacttgccgctactcacgatttattctgacacacgagaagtgcgggtcaacgaccatcaaatcttatatctattgcggcaatggtatacagataaaatatttacggtcaatcaattgtcactgtttaattacgatatcaatttactcttaactcattttcgcgcatcttcatttatggtttcaccaagtctcattgataatacgcaagaacttgcagtggatttagagactgagtttccgatcacaacagacattttggaccaaatctttattactacgatggaaaatcaaggctatgattttgtcaaagcagagtatgaagactatgagatcttcttagataaaaaacaacgcttgacgattcggatggctgatgatcggacccatttgtttattgattcagatcgaagaaaacgttccttgttagatttcttcacttcttacgaatttttagttccattagtagtacctagttattcgcattaaacaagcataagagctaaaataatcattaagattattttagctttttttaggagaggagaatgatgtaatgttgaatcgtgcgatcggattttatgagggaatgcctttagataacagcaatgtttttcaaacgaaagatttggacatgccttcaataggagcaaatgatctattgataaaagttgaagccgtatcggtcaatcccattgatgcgaagcgtcgccaaacgacgaccaaatctggtcatttcgtgatccaaggatatgatgcttgcggaatcattgaaaaagttggcgatcaggtcacagaatttcaagtgggcgacccggtgatgtacagtggaacaacacagcgagacggggcgaaccagaaatatcaagcggtggatgcacgcttagtagcgaaagtctctttagaaaatttagcggaatgggcagcattgcctttaacaagtatcactgcctgggaacttctatttgagaaatttgggttgattcctaaagaaaaagccaatcaaggaaaactattgatcatcaatgcaagtggtggagtgggatcgattgccgcccagctggcacattggtccgggcttgaagtatatggcactgccagccccacaaatcatgaatggctagataaaaatggggtagcgcacccactcgattaccattacccgctacaagatcaggttgaaaccacctttgactatattgctgtcttttatgacatttccgattacatcgatcaatttgctcaattgatccgcccatttggtaaaatcggaatgatcgttaatacgcgcggtccattagatcttaacccatttaaaaatatcggagtggacttttactgggaatatatgtttgcaaaaaccgattatcaagtggatttggctagtcaaggagcgatcttaaaaaaaattgttgatctagtcaatgaacaaaaaatccattctacgatcaccacctgttttgaaacaggcctgacgatcgaaaatttgattgaagcaaccgcattagtagaaaaaggcagtccagggaaggtagtcatctccggaggattccatgagtgaggaacaagaattttgggatgattttgcggcagaatatgcagagatccagcaagaatcacaattaacgattgctgaggatctagcaacatttttaaagacaaacggaattttgccaataagctcttttgttgatttagctgcgggaagtggccgctatattccagcgattttacctgatacaaagcgttatttggccattgatttttcagtggaaatgttgaaagcagctagacgttatgtaaaagatcctcaacaaaaagtagactttcgactgcaaacacaagcagagtttcttgctgataagaccacctatcccttgatatttactgcaatgaatccagcgttgaccgagaaagatcagctgatttctctggtagaaaaaagtcgtcgcttattgattttgcggatcgttcggaccaaagaaaatatctttcaaccactggaacagaacgatcacaaagatgaaaagctactttctgtctataagaaatggcttctggaagaacaaatcagtttttctactcatcttttttcttatgcttatgaagaaatcattgatcgggaatttttttaccgctattttcaacaggatattccacagtcagaattgctgcagctaagccattccctttttagagaaaagaaaaaagcaattagtaagacggagatcgattatgaactcctaatcgtttgaaggcaagcggttgtcctgtatattcagggacagctgcttgcctactagtgtctattagcctatccctaaatagagatagccgattgaaccgattatgaataagtaaaggatattcaccatatagaacttgtgttggaatcttttttgttcttgagggagagcttgcttgatcaatttgtaaccaatcaaattcgctaacgaagcaatcaatgtgcccaagccacccacatttacccccaacaaaacagctttcttgtaggttgtaaaaggagcaatcagaatcgctgctgggacattggaaatcacctgagaaagggtgatgctgcctaaaaaggcttgttgttctttttggaagaagggttggatcatttcaatcaacttgtcttgttcgttgatatttccgataatcacaaagaaacaagcgaatgtgactaagagacggtaatccactgaacgaaagagctctttttgaaaaaaatagaccacgaatgctacgatcgatgccgagaggacgaaaggaacgacatgaaagattcccaaaatcatcagtgccattaaaccaagataaagtaccatgtattttttctcaaaaaaatgcgtggtttttttgatgatgagaggggatgctggcaataattgaatggatcctactaacagagttaatgataggacaaccatcatacctgtcgtttgcaaaaaagtagtcaaaggtaaattataaaaagaaaacaagaagagattttgcggattcccaaagggaaataaactgctgcctaaattagcggctacaatcaggtaaactgcgccgagaagaacgcttttttgttcctgaatgcctttggtgatcagaagatacataggtagtaaagtcaggatcgccacatcgttcgttagtaccatcgagctgaaaaaacttaataaaacaatcgttcgaatcagtgctcggagagaatgactcttagagagcaaacgttgaccaatgaaattcaacaaaccggctttttcaagcccattaatagtcagcatgagaccaaacaaggtcaaaatcacttgaaaatcaataaagtggacatcaaaacgtccaaatgaactcgcaacaagcgccaaaaagaaagaaatcgaaaataataaatcgctttggaaaaagaagaatattttttttaacatgcgtgctcctttctttcaaattttaccatggactcttttagagaagcaaagaaatattctcggttttgacatatactgtgaaatcctatcgctcaatatggttgacaaacgaagcgtttattgggaaattagaactagactgaaaaaggagcagaatcgatgaatttgatgcaactattagaaaaaaatcagcaagtccattttcagatattgaccatcttctttcagcatggttcagaaatttcctataaaactcttgcaaataagttatccatttcttcaccgacgctccaaaaggagattcagcatttgagtgacaatctttctgttttccatgcagaggcattgttagaaacaaaagagaatgatcgtttgcatttaacattaccgcttgatttttctattcagcattttttttatgcgtatttatcagaagcggtggattttcaaattattgaatatctctttttccatcgcgaaggatcgacaacgaaactcatgttggatttgacgcttagcgaggcctcgctttttcgtcatttcaaatcgatcaatcacttgttggaggaatttagtcttcaattgaaaaataagaaactgatcggcgatgagcgccaaatccgctttttcttttattcgtttttttcgcagagttatccgttagcaaaaatcaatgaaacctttaagagtccagctattcgaaacttgattcgggtgattgaacagcaactcggcttatcaattgatccacggaataattggaaattggtcttatggtttggtttgatggaagcccgtttcgattttaggagttcccagcaacatgagtcatcgaaaggcctcttaaaacaagtagaaaatgatcctacttttcaagtgctacgaaatattttaggacgttatctcagccgttttgccatttcgtggagtgactacgaagctgtttacctctatttgtttttgatgatggaaggattagtagtcatggatcaccagcaggacactgattcggaatttatgctagatttagccgctgagagtcaagtattgatgaaaacttttgcggatgaatctcttgatatacaagttcattatccagaaatcagtcgttttttagcaatcatcgttcttagagcacgctacttgaagggctcgttgacttcatttgccgattttcctccgcattttttgcggggaaccatcacggaagtagcgaatcaagcagttgaaacattggcacaagccactgggcctttttctgaggagaaacagagaaagctcatccatgatttgtcgtttgttattgaatggttgcaagagaaacaacaaaaagagctgaaaatcggtgttctgctgtctcaaaatcaattacgtacggatgttttgcggcggtttttggccaaacagctctctgggtatccttacatgcaggtggaaactgcacaagcaaccgattatgatctgctgattgtggatcaaccgcagattgccgaaaactatcactacaaaaagctcctggtcttgacaggtgtgatcgatcgttttgaagagcaacggctgcatcaagtgattgatgaaattcgaagggaaaatcttgaaagtgagttggagaagttatgaggattgtcattattggaggctctcatgctggtatagcagcagcccgccatttaaaacagatggatgataaaattgaagtgatcatcattgaaaaatccaatgtattgggctatatcgctagcagtttgaacttagtattagagggatatattgagcgtctagaagattcccgcactgctactgccagtgaattactgtcagaagggatcaatgtgatgctcaatagccgcgtcgtaaagattgcagcggcagaaaaaaacgtttcttttgaaacatcaacggctagttgtgtcgaaaaagacacgatctcatatgattatttgattttagctatggggtccagtaattttcggaatgcttttacggaagaagtcaaagagcacattaccacgtacaaaacgattgcccagtctcgagcagctctaagcaaaatacaggaagccaagaaagtggccattgtgggtgccggtctgataggttttgaattagcggaatcactaagtggacaggataaagaggtcttcttgattgatcggatggatactttgcttttccgctacttcgaccaagagatttctcagattttgatcgaacgttttccagaaaatttacaaatctatctgaacagcagcgtggtcgcagcaaaacaaactacgaacggagagctggcgggaattgaacttgccaatggcacttttttgccagcggatatcgttgtctatgcagtcaatccaagaccgaatgttgacctggttgctgactttctgaagttgaacccagatgggacgatcgacaccaatgaattcttgcaaacttccgatccaagcatttatgctgtcggcgacttagtctcgatcccattcaatcattcagacagttcactctatgtaccgctggtgaccaatgcgtatagaaccggtatcgtcgcggcaacaaatattttgtctgcaaaaaaaatcccttttcccaaaatgcagcgcacagtggtcagcaagctctttggatattttgtgagcagctctggaatcaatgaaacggaagcaccttattatggctttgacgtcgattctgtcacacgtacgttccatgcacgtacgtttttcgaagtagaaaataattttgaagtgacattgaaactggtatttgacaaggaaacacgagtaatcatgggagggcagatcattacaagcgatcgcggcagtttggagatcatcaatacggtctctacgttgatcacatcttacatgactcttgatcaattggctacgatggattactttttcaatccaacgatatcttttccgctgcactttttgaatcaattggccatcgaaggtctcttgaaatctcacgtgaattaaatgtgttatatattaaaagtttttttattcgataaacctacgttaagagtaggtttatctttttttttgcaaaaagccttgtcattaaaagtggaatcgcttaaactaactagagagaatgagaatcgttctcattagaaagggttagtatatgagaaaaatgagtctggccattttgcttctcttgttgatcactgggtctttatttgtgggcgcacatgacatgtctctagctggtttaatggcaggagaagagagtcattggatgatattgctgaaagtacgcgttcctcgtacgattagtctcttgcttgcaggggctgtcatgagcttatgtggaaaaatcattcagcatctgatgcaaaataaatttgttgcagcagacgtgatcggtttgactgacagtgcccgccttgggatcttgatcgtcatgttatggctgcccaatgcatctggactcctgcgaacaaccgctgctttcttattttcttatgcgggggttttgctatttttatggctaagtcgcttgatccctaagaaagatccgatggttttgcctttaacgggtgtgatgttcgggaatgtgattggcgcagtcagttcctttcttgcgtaccgctttcaacttgtgcaaaatgtttcttcctggttacaggggaactttgctaccgtgatcgagggcaattatgaattgatttatctgacactaccaatttttgctcttttgtatttccttgcctatgaaataacgattgccgggttaggagagacagctgcaaaaaatcttggcatcaactaccacgttttacgcttgctcgtatttgcactggttgcttttgccagtagtgtggtcttgcttttagtaggcagtgttccattccttggtgtgatcatccctaatatcgttgctttatttgcaggagaccatgttcgaaacaacctttttctgatcagtttttccggcagtgcctttttgctcttgtgtgatttgctagcaaggattttaatagccccatatgaattgccggtcagcgttgtagcaggaacgattggcggtattagctttctagtcttattgatgaggagaaaaatggtatgagaattatccggcgttatatgttcttgttcatactcatcgggatagctgttggcgcataccttacctacaatacatatggcaattggtccttcgcactgcaattacggggaaagcgaatagtggcctttggcttagtagcaatagctgtctcgtttagcacgatcactttacaaacactgacacaaaatcggtatctgactcccggtatcttaggattggatcaattatatgtgctgatccagacgatactatttttcttcttaggaggaatccgcatgttgagtcaggaaacacctttcgtttttttgttttcgattttagctaccgggacattaagcagtgtcatcattcagaccttttataaaaaagccaataatcaattgtttctattactgatggcgggaatgatcagcggtactatgttcactagtatcagttcatttcttcaagtcatcatggatcccaatgaatatgatttgttgcaagggcgtctatttgcaagttttagcaatgtcaatagtcagcatttattactggctgctggaattattttaattgggctgattggattatcgctattgattccagaattgaatgttatggtcttgggtgttcgaaatgcaaaaagtttaggcctatcggtttcaatgatccagaagagttgtcttttcttgctgtctttattatcggggactgctactgctttagtaggaccatccgtctttttaggatttgtcgtggcaacgattgcctatcagttatttccaacatataaacatggcacattgtttgttggatcagcacttttagggtttttattactagtcggcggccaattttttgttgagcaagtctttcaatggaacacaacgatcaatacagtgattcaatttttaggcggaatcttctttttaggaaaactagtcaaagaaaggaaaggacaatgattgaaacaaaaggaatcgaaaagagttatcaagacaagcgcgtgttgactgatttgtccttgcagttgccggaaaatcaattgattgcctttattggtccaaatggtgccggaaaaagtacattgctttcgattatcagccgcatgttggagcagactactggagaagtttatttcaaagaaaaggagattcgacaatggcgttcgaaagaattagctaagaatctcgcttttttgcaacagagtaacggttttacggttgatatgaccgtagaagaactggtgtcttttggtcggtttccctataatcggggacgatcaacgccagaagatgaacaaatcatttcagaatcattaacacttttatctttagaatcatttcggcaacgctcgatccatgcattatctggtgggcagcttcaacgggtctatttggcgatgattcttgcccaagataccgagtatatccttttggatgaaccgctgaataatttggatttgaaacatgccaatcagttgatgcacttattggagaaattagtcaaagatcatgggaaaaccgtattgatcgtattgcatgacatcaactttgctgccagatatgcagaccatatcgtagcgatgaaagaaggaagtttgttcaaaacaggcacagttgcagaagtgatccaagagcctgttttaaaagaactttatgacttagaagttaagatagtcgaagtggatggacagcgcttttgttattattttaattaagagaccataggaggagtatatgaaaaaaatagtatttagtttggctgtattggtaatgatcacggggttagcaggatgcggctctcaagaaaaaggagagtcaacaagtgcctcaacggctgcagcggcgcctgccgaaatcgaagtgacagatagtaatggcaaagtgactgtgccattttcaccaaaaaaagtcgttgttttcgataacagtgcacttgatacaatggatgctttaggcgtaggagatcgtgttgtaggagctgctacgagcaatatgcctgactatttaaagagttatgctgcggttgattctgcaggtggtatcaaagaacctgacttagaaaaaatcaatcagatccaacctgatttgatcattatctctggccgccaaagagactttcaaaaagatctggaagcaattgcaccaacgatttttctaagtgtagacaacgaaaacacttggtcatcgatcgataacaacattcaaactattgcccaaatcttcggaaaagaagaggaagccaagaaacagttgactgctctgcaaacaagaatcgcgaatctttctgaaactgcagaagccagcaaggaaaaagcattagttgtcatgatgaatgaaggtagtctttctgcctttggtttgggatcaagatatagcattgtttatgatacatttgggtttacgccagtcgatgatacattagaagcatcgactcatgggcagaatatttcttatgaatatttactggaaaaaaatcccgatattatttttgttattgatcgtacaaaagcaatcggtggggatacaagccagagtacgttgactgaaaatgaattggttcagcaaacaactgctggaaaaaacgggaaagtgatcgaattaaatccgcaagtttggtatttagcaggatctgggatcgaatcattggacattatgttgtctgatgttgaaccggctgttgcaaaagattaaaggcttgttatcggataaggatggcttaaatgagaaacagttgcgaatgttggatgttcgcaactgtttttgtattgaaaacaatttattcaatttaaaccaaatttagtttttttcaggtatgctaggttcaaagggaaggagcggattccgaaatgcacaaatatttgctggcggctgccttaggtttagtactgttaatagggggattatttcttcgggtaaacctgatcccgatcgcagactttgagctattgactttggcagaaaaaattacattacaaacagaggtggggctcgcgccaaagtgggggacagtcttaatgggcagcggattagctattttgttgttggttttcatttcctattattggccctccaaaccggggcacaaaaactatttggtcggtgcgggtttacttgcgctttggataatctgcgtaaagatgatttttttcccgcctcaaaaggaatgggtcgaagggacggtcatgaaagtctatgaggatgggtatgcatgttttcagacgaagaaaaacgcggaatcacgttattcatcagattttggtctgtattatttcgaaagcagcgacagttggcagcttcgagaaggacagcagatcaaagttttaacagaaggtgggagtttcataaaatttgatgaagtgtttttaccggtaattgatgttcaaccgttagcggatgtttctcggtctcaagactgaattaaaaaaagaatcacagatttactttacctgtcgtagtaattgatttataattattacgacaggtaaagtaattttaaggaggggatcgagtgatatccagcgatggaattcggggatacaatgatgcaatcatcttatcgattctttccaaagatgattcctatggatacgacatttcaaaacagatacgtgaaaaaacagattcgctctatatcattaaggaaacaacattgtattctgcattcacacgtttggaaaaacaaggattgatccgctcgtatcctggagaagtgactcatggaaagaaacgcacctattatcaaatcagtgaggcaggaagagaatttttagaagtaaaaaaacaagagtggcagcaaacaaaaattgttgttgagcgctttttacaaggaggagcaaaatgaaaaccatccgggattatttagatagtttgtttttgaatgtacccaccacgccagaaacaaagaaagccaaagaggatttggctgcgatcatggaagaccattaccatgaattgattgaacaaggaaaaagcgagcatgaagcaatcggggctgtgatcagtgaatttggatcaattgatgagttgcttcaagaactgcaagtagcgcagtcagaagatactgcagaagaagcctggttagatgctattacaatcgatgaagcctttgatttttgggggaagattcgccgttttgccttctcactttctttaggtattgcgttatgtatcgcttctcttggaatatttctcttttttgccaatgaaatcgatagtggcttaggactattagtcatgttcatgtttgttgcattgggcgtgggctttattattacctccggcttgaactattctgcatcaaaacgaaaattaaacgatcgtccatttgatcaagaagtaaaacaagaggcgcggaagcaattggaagattatgaaaagagttttcgatttggtctggtgctagggatttctgcatgtattctgtcggtgacaccctttttcttgatggaagctattctttacattcccagtggtttagctttaggactgttttttgcggcagttgcattaggagtattctttatcgtctatgtcagtatcatccgcacaggatttgccaaaatggccgatggcgtttactttatttctaatgaagatgaacccggaccacgggcagcgcaacacatttatggagaatccgcaggaaaagttcgcttttttaatacggtttattggccagtgatccttgtggtttacttcctctggtcattttcaacaggaagctgggcctattcatgggtaatcttcatcttgggtggggtttttcaagatttctttttgcctcatcagaaaaataagcgctaaggaatttcttgaaatagtttttgataaacatctgaaagatccgaggttctgctagagcagaagaggagtccttcaggtgtttttcttatcggtttggacaaataaaaacttttcactttgatgaatttgacaaagtgaaaagtgacttaaagttattgagaaaatatccttgtaaatgagaatgagtagccttgagggtataattgttagaaaagtgaatctatttattttcccagaaatcattttaaaatgaaagtgaaacgctcatttatgaggagaaattcattttgtttaaaaaaatgcaaagagactattgcaattccactggctttagactaataattaagagagattattctcaaataataattctaattggaggaatcgctatgtcattaattggaaaagaaattgagtcatttgaagcacaagcttatcacaacggaaaatttatcgacgtttcatctgaagatttcaaaggaaaatggaatgtggtttgtttttacccagcagatttttcatttgtatgtccaacggaattagaagatctacaaggtcaatatgcagcattgaaagaactaggaactgaagtttattctgtttcgacagatactcactatacccacaaagcatggcatgatcactctgatgcaatcagcaagatcgaatacattatggttgctgacccttctcacacgatctctcgtatttttgatgtactggatgaagaaagtggcctttcgcaacgaggtacttttattatcgatcctgatggcgttgttcaaacggttgaaatcaatgcggatggaattggacgcgatgctagtggattgatcgacaaaattcgtgctgcccaatacgtgcggacacatccaggtgaagtttgcccagctaaatggaaagaaggagaagacaccttaacaccaagtcttgatctagttggaaaaatataggaggttgacatggctttagataatggaattaaagaacaactgaaacagtatctggcaatgctggaatctgaaattgttttcgcagctagtcttggtacagatgacgcctcacaaaaagttcgtgatttcttagaagaaatcgcagaaatgtccgaacgtattacgatcgaagaagtaactgcagatcggacacccagctttacaattatgcaaccaggtatcgacagtggcattgcttttgcaggtcttccactcgggcatgagtttacttcatttattttagctttattgcaagttagtggccgggcgccaaaggtcgaacaagcgattcaagaccgtatcaaacaaatctctcagcctttgcattttgagacatatgttagtctgacgtgccataattgtccggatgtcgtacaggcgttgaatatcatggctgtcttgaatccgaatatcagtcatacgatgatcgaaggtggtatgttcaaagcggaagtagatgccaaaaaaattatggccgtaccaaccgtctttttgaacggggaagaattcgctagcggtcgtcagacgatcgaacaattacttgaacaagctgctggtccgactagcaaagactcgtttgcagataaagatctgtttgacgtgttggtcgtagggggcggtccagcgggtgcaagtgctgctgtctacgctgcccgtaaagggatcaatacaggcatggtggtggaaactttcggtggtcaagtgatggaaacattaggaatcgaaaacatgatcggtacaccttacacagaaggaccaaaattaatgcgtcaagtggaagaacatgtcaatgagtataatgtagatgtcatgaaaggacaacgtgccaaagatatccgcaaaaatgaattcgtggaagtggaattagagaatggtgctgttttgaaaacaaagacagcgatccttgccactggtgcacggtggcggaacattaacgttccgggagagcaagagtttaaaaataaaggggttgcttattgccctcactgcgatggtccgttgtttgctggtaaagaagtggcagttattggtggcggtaattctggtattgaagcagcgattgatttggcaggtatggcaaaacatgtctatgtattggagttcttgccggaattaaaagcagaccttgttttacaaaaacgactagcaacattggaaaacgtgacggtcatcaccaatgctgctaccaaggaaattgcgggttccgatcatgtggagcagctgacttatgtggatcggcagacaaatcgtgaagccactttagctgtggaaggcgtctttattttgattggcttgatgccgaatacagaatggctgaaagatcgagtggctttgaatgaacgcaatgaaatcattgtcgacaaacatggaactacagatcttgctggagtttttgctgccggagattgtacagacagtgcctacaagcaaattattatttcgatgggttcaggagcaacagcagcgttaggcgcatttgattatttgattcgccaataatcaaatgcggactgatcctttaaataggtacaaggaatgactgcaacgccgtttaccaatttgattcatttttgatccatgatcattgcagctgatggctgaacttcagtcaaatagttgccagttgattgggtctcgatggatcgatggcaaatggctgttgcagtttttttgtcctgaaaataacgagaaatctctaactaaaaaaggcagcgattcaatgagctgtgagaaaacaggggaattagtcaattgcttaaagatgtttaagaataattaaagaaaaacacaaaattgcggaattcagttgtcatcatgaggaacaaaaggtaacattcaggatgaataaaaataacggataaccttgttaggtgaggctcctatacaaacataagctattgcgcagaaacgtcgaaagacgccaatgtgtaaaacaggaattgtcggattaaggctcttcataaaatagctaagaagaaataaatactactaatttgcttcttctttacgttgtatagtgccaaaactcggacgatgagattgcttgcgaagtcgaacgtcttgagagaagtttggctttttttcttttcttgagtatgtttcaaaacgtaaatggataaaataaataacgtctgaaatcacctgctccaagggaaggagtggacgatatgagtaaaaagagaaagatcgattggttacttatcacagcttatttgctgttgagtatcatcggtcttttaatgatttatagtgcaagttcttaccggttgatgactgctgggggtgcaccggccgcgttgttccagcgacaactgatttttctgctgttgagttggggaatgattcttttgattcaaaaaacccgcgtcgaaattttgttaagcaaaaagttagctgtgggactattggcctttggcattgtcatgttactgttggcctacctgccatttttcggggtatcagttaacggtgctcagcgctggatttcgatttttggcattcagtttcagccttcagaaataacaaatgtcggtatgattctttatttggcaaactattttaaggacaaacgatctttcaatgaattaaaaaagccgctctttctcttatttctatgttgtgggctggttctaatgcagcctaaagttgcaggagtaatgattttactatttttggcttttgttatgatcacgactgttcaagtgccagtcaaagtcacattcctgctatttactgcactgatttccagtttatttcttttaggaggtgcggtcctctttttaggacaacacggctggttaccacaatacttcatgcatgtatacaaccggatccaacttgttggagatccattttctgacccatatggtcaaggtttccaaatgattcattcctattatgcattattcaatggcggattaagcgggttgggtttaggcaatagcatcacgaaaaaagggttcttacccgttgcggagacagacttcattttttcggtattggtagaggagcttggccttttggtagggatttttgtaattggattattatttctaattgtgttgcgcctgtttattcgttcggcaacagctattgattcacaaataggcttgattctattaggaactgccacattgttgttattgcaaacaagtatcaacatcgcaagtatcttagggttaatgcctatgacaggggttcctttaccatttattagttatggtggctccagttactttattctttcgtttgcttttggtatttgcctcaaattggaaagagggagggaagcaaatgaagtacttcaaacgacatgaagtgaattatgcactgattctaccggttttcttactttttttattgagtattgcggttcaatatggtgccagtgtgctggatggcattgatccgggaccggttgttgtgcggcaactctttttttgcatcattgccgcaatcgcattgtttgcgggcagtttactttcgacgacttttttattgcggttctctggcatcttttatgttctttctctaggattgatgacattattgtactggttttatgatcccgtcatgtttgagttgacccatacaaaacgttggatccgaatcggccgtttcacattgcagccttctgagattatgaaattggcttttgtattgtttatggtgtatctcacactcttatatgaaaaaagacagattcagcgaacaatcaaatctgactgtttctacattctaaaaatagtgctttatagtttgccgacttttctattgatgtatatgcaacgggactttggtactagtttggttttcatcgtaatgctcggcgcactatttgttatttccggtgtccattggaaactgttgacagtaatttttacggtattggctgtggttggcggactgttattgctattagtctttactgattgggggaatacgatgttgtttcgattgcattttaaaccctatcaattggatcgagtcaaagcttgggcagatccttttgcttatcaagactcgattgcttaccaacaagtacaaagtatgtgggcaattggttcaggtggtctcctcggggcaagtgacacgcacattcctgtctacgttcctgtgcgtgaatccgatatgatctttacagtcatcggagaatcatttggatttttaggcagttcattagtaatttttctctatttttatttgatttatcagatcatttttgcagcattgcggacaaataataaagcctcggtctatctatcgatcacgtttgtttttggtttggtttttcaaatttttgaaaatatcggggcggcgattggattactgcctttgacgggtattccactaccatttctgagtcaaggtgggacctcgctgattgcagttggtctctctttaggcattatttttgggctggagaaggcgtatgccccgaaaaaaactttcccaataaattaaaggagtttactaaaatgttcaatcgaactcatcggatgacggtcagtcttagctttattgcattgttttttttattgacgatcctagtcttgcatcagccacactggtttcaaaggatagaccgactcttttggaatttgcctcagatgcgcactgctttaggagaccaaatcatgttgggcatcgcttcgactgctacgatcctaccaataactggtttatttctgcttttgggcatctatttatggaaaaagcagcaacgagtttgggcaatctggggaataggaaatctgattgtagtgagtggtatcggtcaagtgatgaaatggctgattcagcggccacgcccagtcctagaagctgggatggttcgcgattcacacagctttcccagtggccataccctgctagctgttacactggtgactacctgtttgcttttcactcgatttttgtttaagaaaaaaggtctgttggctatcctcggcggctctttcatttttttagtaatattttcccgcttttatttaggcgttcattacccaagcgataccctcgcaagtatctgtttagcaagtgggatcacattgatgacttatgaatggactgaaaggattcttacgagtaaaagtaacaatttatccgataaattcaagcaaaggagaagaccatgacgaatggaaagaaagtttggctgacgcttttggttagtttaacactgcttgtgaccgttggaacagtctatgcgctgcgcatcgttcttcgtgcagaacaaacggttcaaaccatgcacgcaccgattaaagggcgagaagcaacagtaattgaagaggtagaacccctaagtctgctccttttgggtatcgcaaatgattccaagcgaaaaacagactatcgtgcgaacacgatcatgatcgtgacattgaatccaaaaaataagcggacatccattacaagtattcctcgtgatgcttatgtagagattgttggtaaaggtttcaaagataaaatcaatcatgcccactcatttgggggcgccgaaatgatgatcgcttcgatcgaacaatttttacagatcccaattcatcattatttctcgatcaatatggatggcatggtagatcttgtagatgcgattggcggaatcacagtttacaacgattttgagtttacggctgagaaaattcattacccagagggggagcttcaattagatggttgggcagcacttcagtatactcggatgcgtaaagatgatccagaaggggattatggccggcagagacgacaacgacaagtgactgagctcctcgctaaagaattgctgtctctgtcaagtttgttccagtaccaagagctcatgtcgatcgttggagaaaacggccaaacggatctcacttttcagcagatctcacgattaataacgagttaccagtctaccctaacaacagttgatctctatcaaatacaggggacaggctttacgggagatggattgcaaggagaagcagggatttcttaccaagcaatctctgatgaggaacgacagctagtgatccagcgattacattctgaattggatatgcaaacacataatgaaccggcagaatagatgatgttgacaattcgatcatagatatactaaaataaagaaaatcgttcaaaaaaagaaagaggtctcttgatgagtgtcttaggtatctaaccagcaaatttaaacaaataaacaatactaagtttatttgttgtgcctgcagataccgatcaaaatcgttattgataaaaacaggtgatggggaactgtcaccttttttgtacactttttttgaacgtggaggagagacgtttcacgggcacaagaaaggacctcatatgaatatcccacaagaaactgaatttgacgcaattaaaacaactgttagtcaacgaatccttagtgattatggcaagcaacgatttgccgaacaacaaccggcctcttctattcattccgctagaaaaagactagcggagacaaaagaagcaatggccctcttaggctctgggcaacaagtaccattcatgggcctgtctgatattttgcatcatacgacaaaaatcgaaaaaggcttgattttagagccgagagaattgatcgattatggagactttttacggtcttttcgattgatccgtcagatgtttgaaaaaaaccagtggcagacaccgcggcttactggctatgcgcaaggattaacggatttttcagacaccgcacaaacaatttttgacaaaatccgaaatggccggattgacaccgatgccagtcgtgaacttaggaaaatccggggacaaatagccaagcatgaagcagaattgaaaaaagtcttttcaaagtttttgcaagatccacgactattacaagatgcacgaatcattcaaaaaaatgatcgctacacactacctgtgcgctccgaatttcaacatcagatcaaagggcagattattgaacgctccaataaacgggcaacagttttcattgaaccagaagcagcgattcgcttgaacgatcgcttgataatggccaaagcagaggagactgccgaggagtatcaaattttagctggattgactggactgcttgcagaaaacttaacagaaatttttacctgtctggatgtattggttgaattggacatcatctttgctcgagcaaaatactgtcgtgaaattcatggtgttccgctagaaatcaatgaagcagaagtaatcgacttacaggaagttcgacacccattgttaggagcagcagcagttcctctgtcattacaacttggttacgatgctcgctgtctggtgatcacaggtcccaatgccggtgggaagacggtggtgttaaaaactgtggcactggtttgtgtgatggcgcactatggtctctttccttcacatgctgggggaagtcaggttccatttttgaaaaatctgtggatggatattggggatcaacaaagtttagcgaacgcattaagtaccttttcgggacatatgaacaacattgcccaaatcgtcaagcatgcttcacggcaaagcattgtattgctggatgagatcggcagcggaacagagccaaatgaaggagctgctttagcgattgcgatcatggaagccatctatcattcaggtgcgcttttgattgctactacccactatggggaaatcaaacagtttgctattgatcatcaagatttccatacggctgcaatggcttttgatccagaaacattgacacctaaatatcggctgctttctgatgctgtgggtaccagtaatgccttttggatcgcagaaaagatgtcagtctctaaagaaatcgttgctaaagcacaacgatacttagaaacgaaacagtatccaacggaaaaagcagtatttaaaggcatccagaaagaacgacagcaagtatccgtggctactttaaaaaaaggcgatcgcatctcttacacagagacaaatcaaacgggcttgttttatgcctatttagaaagcaatcaagcacagattttgctggatgaatcattggttatcgttcccactagaagagtcaagcttctgatgtctagagaagaattatatccagcagggtatgacttggagagtctgttccattcatttgcagaacgcaaatttaaccgagatatcgaccgtggatcgaagaaagcgcaaaagaaattaagaaaacaagcacaggaaaggcaagcatttgcgaaaggcgacggcgcgcaaacgtaattgatcgcaggaaataagctagcgaagataactttcagtaaaaatcaagctattttgcaacaatacgcaagtgtttccaataatggtagaaatagcgctagaaatgcaataaatatataggatgctcacagcaaaggtccgaaagaggggaaagagatgatagaaacaacgcgtttaattttaagacattggcagaattctgatgccaaagagttgtttgagttggcaaaagatcctgctatcggcccaagagccggctggtcgccgcatcaatctgtggcagaaagcgaaacaattattacggatgtttttaacacgaatgaaacgacttatgctatttgtctgaaagatggcatgccgattggcagtattggtattatgccaatcagcaaagaatttatgctcccgcctgcagttgaagtaggctactggatcgggaaagcttactggggacaaggctatacagtggaggcgttgactgcgatccttgctgatcagtttgccagggaaccgaagctaacggtttgggcaggctattatgatggtaatgaacaatcttggcgcgtccaacagaaatgcggttttgtctatcagttaactcaaacagtcgaggttcctctgttaaatgaacaaagaaaagaacactttactagcctcacgtataaccaatggctagctgtctcagagaacggccaaggaacagcaattcaaaagaaagaaaacaattcatcaacgattcactatagcaaacaccttccagaggacccacaacaaatcctttcgttgtatcaagatgctggctggtccttgtatattcgcgaaccagaagtcttgtgggcagcacttcagcaatcccacatgatcactgcttggcagcaagagcgcttagttggtttggtgcgaggaataacggatcagcaaacgattttgtatatccaagatttactcgtattgaaagaattccagcggcagggaatcgggcaaacgttactaaaaaaaatagtaggagactacccgaaaattcgtcaaaaaattttattaactgacgatacgaaaaaaacgcgggctttctacgaagcttgcgggttccaaacagtggagaaaagtcatgcggtcgcctttttatatgccgctaacaaagttagtgaaggtctatcttcctaataaataataggaaaagaagtaggaaagtaaacagggaagtaagtaggtaaataagtaagaaaagaagtaggaaaaactagtggcataagtcttaaccaagaagacacactcgatcactaaagaagccgtcctctggatgtcgtcttataatggctgatcttgactgttgtgatcgaaggtttatcagactgatgccactagtttttttgatcgtagcaaggacttgtctctagcaaacctcttgtttcatttttctagcgggaactcagaaaacgtcaaatttaataacattaatgaaataattttattgaaattttgtttttgtgacaaaaaaatcggttaagacatagtgaatatgctaaactagtaatgattgtttaacaaaaaaacaggaggtttttctttggagctattaaaaaagtcgaaattatttgcagtacttgtgtttatttgtttggtgggactaggcatatggatctattcaaatattctgtttgtcttccgcccgctagaagccatttttgctagtgtctttttacccgttttgatttctgtatttattttttatatctttttgccttttttcaatttgatcaaaaaaaggagcagcaatcaacatctcgctctttatgtcacattgcttctgatcctctttgctgcttatttaatcattcaggtgatcggtccggcactgattaacgaaatggcacgttttatcaatcagattccttacatcatcaacagaatcattgacaatatcgatcattcttcttttgaggaattatttggtccactgttagattcattggatatcaaccaaatcagtaatctcgctgctcagtttatcactggggctacgaatagtctgacaagtttggtagcaatcgtctctcattcagcgattgttttgttcacgattccgttgctattggtttatatgtttaaagatggacataaggttcctgatcttttggtctcgaaagcaccaaaaaaaattcgctctcttattctgcagttgtgtcaagattttcatcaagctgcttcagcatatattagcggaaagctacttgtctgtttgtatgttggcgtcttcagctatctaatctttacatttttaggcttgcaaaatgccttgttactaggcttaatctgtggtgttctagatatcattccgtattttggtccttttatcggcgcggcaccagcattcttgtttgctctgagtcaagatatgaaaacagcagtcttgttagttattggcattacgatcattcaatttggcgagtcgtatgttgtttcaccaatcgtcatgaataaagtgctacatatccatcctatcattgccgtcttcttattattgatcgccgggaatttattaggatttgtaggaatgatcgttgcgctgccggtctattcgatcgtgatggccatggcaggcactttgacccgctattatcaacagcaaaaacatgtaaagcaagaaggaaaagaaaatgaaaatcgttgaatatgcaggggacaaagaagattttgtactagcaaaaataatacggacctcttttgatgcagataccgcatgccatttgggggcagacaaacgagacggtccatctggctatcataatggagaattattgaaacgagtgaagcaagatccagatctcagtctttacctgctgcaagaaaatggcattattggtttgattgtggcaaatcctagtaaacaccagatttgctacttttgtctcgaccctgattttattggtaaaggggttgggactcttgcttggcaattatttgaaaaacgatttcccgtcgattactggatactagaaacaccagcatattcccttagaaaccagcgtttttacgaaaaaaatggctttaaaaaaattggtgaaaaatggtatagtaaagacctatcctatatctaccaaaaaaaattttgataaaatcgcaaagtgagggaaggctatcatgaaagtcttatggaatgaagagatcgttgatcgacaagaggttcaaatcgatatcgaagaccgcggctaccagtatggagacggaatctacgaagttattcgcatttatcaagggaaaatgttcatggccgaagagcacttgcagcgactagagaacagtgccgctaaaataaaaatgacattgccttatgaaaccaccattctcaaagacagattacgttcattgatcgacattgagggaatcactgacggagaagtgtatttgcaagtgacaagaggggttttaagtccgcgaaatcatgtttttcctcctcaagggacgataaaaagtgtccttactgcaaatgttattccattccatcgtccagtggacatgcagcgtaatggtcttcaagccacattaatccctgaccagcgttggcttcattgtgacatcaaatcattaagccttttggggaatctgctctctttagaggaggctcggtccaatggttatgatgaagcactactgcatcgagagggcttttttacggaagcttccgcttcaaatttatggtttgtttccaaaggaacggtgtatacgcatccggatggcaatctggttttacctgggatcacaaaaatgaaagttttaagcttgtgtcaggaattgaagctaccagttaaggaagaagccgttgcgattgatcgattagcagaatttgatgagtgttttattaccaattctgtctgggaaatcgtgccaattgttggtatcgatggtcatccggtgggaactggacagctaggagctgtgactgctaaactacaacaagcgtatattgaagcaaccaaaaagaactgactccaaacaatacacccacctgagatagaaatccccctaagagttagctgactagcgacctcttagggggattttaccatttagtagatgttagttgaaataggaatcagagacgtgctagcagaacacttagttttttcaagtttctgtttcattcagccacgtcgtttactgtgcttagcaatcaattgttgggcgtttcatgttgtcaaaaatggtcttaccagtcttggggattccataatttactgtccaactcgccttgcttcagttgaattcgtgtttgttgttgtgtcaaaagcacttctaattcttgcaagaaggctttctcatgataattgagtgtctcctcggtttgttcttcaatcaaggagtggatccatgcctcattcattcgtaagcctccatttcagcaagagcttcatctaattcaagtaaggtttcctgattttggataagttgatcgagaagaggagcgagttttggattttcagctgtcagtgcttctagtctttgaataaaccactgttgtttggcagcaaatgaaaagggggcttccattgtcagcagctgctgatagtcgatcacaaatcgccgtttctctttttctgttttatacattaactgatcgagaacgagaaccggtaagatggtcatttggtatttttgtgccattaaagttagaggtcgcaaaatttcagaaaaactggctccttcttttccacctagttgaaattctttggctgcaacgcctgtagaaagagcaaagccgatttctttatttaataagtagggtttggctgcctcccaaaccgtatcgatccaacatttcatttttgcaggaacttggtaccaataaagggggaactggaaaatcagacgatcgatcgtttgcaatcgttctaactcaatctctaaatcaaaatcccccgcaactttgtcaagcatatgaacactgacattaggcatcttggcactttcgctaaaaaaacgttgagataaagagtcgtcataggacggatgactggcaataactaatgttctaatcataaagaaaatcaatcctttccctatagatgtaacataattctgccaaaaacggaactactctgcttttaaattagaaggataaatgtgagagaggctaaagtcattattggttcagtgaaatctttactgacttgaatcgtccgtctttttttgctatactgtttagtgaattgaatagaagacagacaaaggttgagcatttcgatgcttcaaggatcacgttctccaaggggtgaggagaacattcttgaaggcgtgccgatcttttttttgaaggcatacttctttacgaggtatgccttttttgtgtctatttttcaattgtcttgtttactttgacaataggagggatattttgatggaagaggcactgaaacgcctgcaagaggcagaagcctataatcaacagcagatgcagcaattgcaacgggcgctgtctgattacgaagaagagaagcaggaggaactacaacagcgtgtacttgaattgagagcagcatgtctgcgtgaacagtccgcacttgaacaacaattacaacaaacgttgcaaaaaacgacggaacagatcgaagcagagaaacaacagtttattgcagatctccaagaaaatgttcgtcgctgtcaagaacaaatggtcgatcagatcgttgaaggagtgatccaaacttatggcagtcacgaaactaagtaagctgaccttgatcgcccccgaaaaccatcaagagcggttattgaaaaaactgcaaagcttacagatggttgagattgaagatgtctttgaaaatgcagaaaatcaaccatggctcaaagaattttttgctgattatcaacaagagacagcgactagctacgcagagacgcttcgcaggatccaagaagcaatcttgttcatccggcgacaaggcggaagcggcaaaatacgagagtggcaacgccaatctttacaactgcctgcatttgaagactcctttcaagagcaaactgtcttgacgcttgtcgaacaaattgaagagttgcagttacaatggcaaaaaaatcatgaagcgatgcaagccgcttctcaatcagaaacctgggcaatggaatggcaaaacctggatgtttctctcgaagaaaaagagttggcatttgccactttcttttgtggcagtgttgaaagttctcattgggaagccatatcagcgaccctcaaacaacttgatgctgtttacctggaaatgatttattcggatacaaaaaagacaaatttcagttgtctttacccgaagaagctttctgcagaagttgagaatgtttttcagcgatatagtgtaaaaaaagaaaatacggacagtctgaaaaaaccaaaagtgctgttgcacgaggcccaggcaaaactgcgagagctagcggatcagcgaaaacagctggcaaatcagattggcacgtataaaactaagattgcttgtttgcagcaagcagaagaatattttttgacaaaagaacaacgaaaaatggtacgaaaacgattggtcactggcaaacatcatactgttttgagaggctgggtcgcgcaacaagatcaacagactcttgaaaaagagctggcagattcttttaacggcgaagtctattgctcattcaatgaacctaccttagaagaattgactgcgaatcaagttccagtcaaactgcaaaatgcttcgtttatcaaaccatttgaaatgttgacggaaatgtatagtttgcctaaatatgatgagatcgacccaacgccttggatgacacctttttattatgtcttctttgggatgatggttgctgatttgggctatggcggattgatggcactggtgaccactattggcctgcactttttccgtttacctaaagggacgaaacggtttatgaagctgtttcaaacattatccggtcctacgatgatttggggattgatctatggctcgtttttcggagcgactttgccatttcatttgttatcgccagcgaaagactttatggctatttttggattatccatgatttttggagggatccaattgtttacaggtctttatttggccgcgaaggaaaatattcgcaagaaagattttttagcagctgtcaatcaaggcttttcttggcaaggcttgctggcgggacttttggttgctgctgctggaaattggctctttaccgccccagcactcgtcacattaggattgattatagcaggacttagcgggctgctgatcgtgattgtgccgatcattaaaggaaagtccaaagttggcggttttttcatggggatctatgatctctatggggtaacaagctatattggcgattttgtcagctatagtcgtttgatggcgttagggatctctggcggcagtatcgccgctgcctttaatttattagtgggctatatgccgccggtagcacgattttctgttgggatcattctgttagtgatcttacaggcgctaaatatttttttgtcattactaagtgcttacgtgcatgcagcgcgtttacaatatgtagaattttttggcaaattctttacaggtggcggccgggcgtttgacacctttaagccgagtgaaaaatatgtcgattttgaaaaagaaaacggaggaaagaaagatgattgattacttgattaataacaacggtggaatggtatttgcgattataggaatgggaatcgcaacgattttttctggaattggttcagcaaagggtgttggaatgacaggggaagcagctgcggcgttgacaacgaatcaacctgagaaatttgggcaggcactgattctacagttactgccaggaacccaaggtttgtatggttttgtgattgcctttatgatctacggcagtttggcagcagagatgtcgacggtgaccggaatggcctatttgatggcttcattgccggtagcttttaccggattgttctctgggatcgcacaaggaagagtggccgcatcagggattcaaatcttagctaaaaaaccggaacactttttcaaaggagttatgttctcagtcatggtggaaatgtacgcgatcttaggcttcgttatttctttcctactattagggtccatttaaaggaggcgacaagcaatggaggcaatggatgccatcgacaaaatgattgctgaactagatcgggaagcaaaagaaaaacggcaagtaatcgaaacggacactaaaacaaggatcgatgccgattttgcagctgcctggtcccaaaaagaactagaaatcaagcgccattcagtagaagcaaaaaaacaaatcgaaaaaaactatcagcaagacatgaatcggcgaataaaagcagccaaacaagaagggattaaacaagctcataaagaactggagacattattcgcggcagcttatcaaaaaatgaatggattggcgcctgatacagtccaacatctggcggaaaatacattaatgcaattacccgtttcgggagaagtaatctttcgttgtggacagcaacagtcagcaagtttgacaaaagattggttgactgctgtcaatcaaaggttgccttatcttgcaaggatgggcaaaccattggagcaagcagggtttatagtagaagacaatggcgttttctacaatttcacctaccaagctttactagaagaatacaaaaatgaaacgagagaacattggctgaaagtgatccaaaaaggagggtaagctatggcgagctatcatcaattgaatccactgattcggatcaaagagacaaccttgcttcaaatgcaagattggcagcagctgattgcagcagagtctatggatcaagtaatggcaatcttgcagcaaacgaattatcaacgttatctgggcgctgatttttccgaaaaatttgaggggtatctggatcaagaaatgctgacaaccatacaagaattagcagaaaacgttccagatcctgatgtgcttcgtttgatcatgctgccgtatacctttcataatttgaaggtattgaccaaagaagatgtaacagggagagattatagcaatttactgatcgaagatggattctatacgatcgatgaactaagaaatgccatccaaacaggatcttcggaaagtataccgtctaaagtcattgaaacgatccaagcagtaagggaatacttagaaggttctgctgttttgcaagggatcgatattatttacgatcgccgctttttacatgagcaacgacgcctagccgaaaaaataaatattccagcactgacacatgcggtgatcacaggaatcgaccttacgaatatcacgattgctgcacgttgtttgctgcaaaaaagatcaaaaagttttatggcggctgttttagtcagtgtgggaagtattcccaaagaagattatctcgcttttgcggaaacctccttcactgactatctcgcctttttgaaacaaactggctatcaagaagcgctactgccgctattacaagagaccacgatcgattttgctgcattggcactggtgaaagatgacttagttactcagcagttcgtagctgctgaagcgttgggaccaatgccattactcgcgtttttaaatgccaaaacattggagattcagaacttgcggctgattttggtaggaaagcgcagtggcttcacagaagaagagctgagagagaggatgaggtactatggcagctaagattggtgtgatcggcagcaaagaatccgtgttaccttttcagctgtttggctttcaagtgtgttacgcaaccgcaaaagcggaagtgactcgtgcctttcagtgcttagtgaaagaagagtatgcggtgatttacgtaacagaaaaatgtgcggcattgattccagaagaaattgccaaataccaacagcaagtttcaccagcgatcatcttgatcccagattacgatggatcccaaggggtagggctgaaaatgatccaggaaaatgtcgaaaaagccgttgggcaaaacatactatagaatggagctgatgttgtggaaacaggaacaataattaaagtgtcaggtccgttagttttagcaaaagatatgggccatgcaagtttagaagatatttgttatgtcggtgatctgggggttgttggagaaatcatcgagatgagaggaacgatcgcttcgatccaagtttatgaagaaacgtcaggtatcggaccaggagaacccgtccgaacaacaggagaaccgctgtctgttgagttagcaccgggaattatgtctcaaatgttcgacgggattcaacggccattagaaacatttatggagctgacccaaagtaactttttgaaacgaggggtccagctgcctgcattggatcatgagaaaaaatggacctttgaaccgaccattgcggtgggaacggaagttactccaggaatggttatcggggtcgtccaagagacgccattgctcctccacaaaattatggtgcctaatggcgttacaggacgggtcaaagaagtttttgctggtgattttacgattgatgaaacggtttatattcttgagacaccaaaaggagaacgctccttttcgatgttgcaaaaatggcccgtacggcacagtcgtccagtcaaacagaaattaaatccggtagagccaatgatcactgggcagcgagtgatcgacactttctttccaatcgcaaaagggggagcctctgcggtccctggccccttcggtgcgggaaaaacagtggtccaacatcaaattgctaaatgggcagatgtggacttagtggtctatgtaggctgcggagaacggggcaatgaaatgacggatgtaatgaatgaatttccggaactgattgatccacgaagtggcgaatccttgatggctcgtactgtactgatcgcgaacacttccaatatgccggttgccgctcgggaagcttctatctataccggaatcacgattgcggagtatttcagagacatggggtattctgtagcgattatggccgattccacatctcgttgggcggaagcgttgcgagaaatgtccggtcgcttggaagagatgccaggtgatgaaggctatcctgcctatttgggcagtcgcttagccgagtattacgaacgatccggtaaagtgatttgtttaggctcggaacaagaagggagcatcactgccattagtgcagtatctccatctggaggggacatctccgaacctgtcacgcaaaacaccctgcgagtggtgaaagttttctgggggctggatgccacgttagctcaaaaaaggcactttccctctattgattggctaaaaagctattccctgtatgagaatgaaatgggcgcttatctggatcgtcagttgcaagtggagtggtcgaaaaatgtgactacggctatgcggatgctgcaaaaagaagctgaactttctgaaattgtgcgtctagttgggattgatgccttatcggataaagatcaactattgttagagatcacgaagtcattgcgagaagattatttacaacaaaatgcttttgatgctgttgatactttcacttctcgagaaaaacaatttgaaatgctgcagaccatcttactgtttcatgacgaaggtcaaaaagctttagaattaggcgcctatttgacagaaatctatcagggaacagaacgtctgcgagataaaatcgctcgcatgaaatatcttccggaagatgatttagaaggaatccgcaaattggaaagcgagataaaagatacgatgaaagaaatcttgcagaaaggagatcgtacggatgatcaaagaatataaaacgatcggggaagttgtcggtcctttgatggcggtcgatcgtgtctcaggagtgaaatatgaagagctgatcgaagtacgtctgcaaaatggtgaaattcgtcaaggtcaagtcttagaaattcaggaagataaagcactggtgcaaatctttgaaggtactggcggaattaatttacgagaatccagtgtgcgcttcctcggacatccgttagagctaggtgtttctgaagaaatgattggccgggtttttgatgggttaggacgagtcaaagatggtggttcagaaatcattgctgagaaacgaatggacattaatggggaagtaatcaacccgatggctcgagattacccagatgaatttattcaaactggcatctcttctatcgatcacttgaatacgcttgttcgcggtcaaaaattaccgattttttctggttctggtctgccgcataaagaattagcttctcaaatcgctcgtcaagcgcaagtgctcgacacagaggacgactttgcggttgtttttgcaggtatcgggattacgtttgaagaagcagaatatttcatggaagattttcgccaaaccggagcgattgatcggtctgttgtctttatgaatttggcaaatgatccggcaattgagcgaattgctacgcctcgaatggctctcacagctgccgaatatttagcttatgaaaaagggatgcatgtcttagttatcatgacggatatgaccaactactgtgaagcgttgcgggaaatatcagctgcccgtcgtgaggtacctgggcgccgaggctatcctggttacctctatacgaatctttccacattatacgagcgagctggccgcttacggggagtgaaagggtcggtgacccaaatccctatattgacgatgccagaagatgacaagacccatcctattcctgacttgactggttatatcacagaaggtcaaatcattctttcaagagagttatacaaaaacggcatccagccgccgattgatgtcttgccttctctttctcggctgaaggacaagggaacaggtgaaggcaaaactcgtaaagatcatgcatcaacgatgaatcaactcttctctgcttatgcgcaagggaagcaagccaaagaactcgcagtcgttttaggggagtcagcactatctgatgtcgataaaatctatgccaagtttgcggaacgctttgagaatgaatacctggatcaaggttatcaaacaaatcggtccattgaagaaacgttggatcttgggtgggaactgttggcgatgctgccgaaagtagaattgaaacggatcagcgatgcgttactagaggcgtttttaccacaaggagaggatgcagatgagcagacaaaccgttaatccaactcgcatggaactaagccgcctcagcaaacagttgacgactgccaaaagaggtcataaactgttaaaagacaaacaagatgagttgatgcgtcagttcatcgaactgatcaaacaaaacaaccttttgcgtaaagaagtagaaacacaactacatcgtgccatgaaggcttttcgcctagccaatgccacgatcaatgaaaagtacattgaagaaatgttcatcttgccagcaacagaagtttctcttgatgtctcaaccaagaatatcatgagtgtggaagtgcctgtgatgcaattcgactatgatgatgtggtgatgcaggcaccgatcgagtatgggtttgtgaactcgaatgttcctttggatctggcaatgggacgtttcaccgatgtcttgcctaaactattgtctttgacagagatcgaaaagacctgtcaattgctggcggatgagatagaacgaacacgccgccgggtcaatgcgctagaatatttgacgataccagaattggaagagacgatctatgggatcaaaatgcgtcttgaggaaaatgaacgcgccaatgttactcggatgatcaaggtaaaaaataaaacaaagtgaatgccacgtcagtcgaaaatctgcttggcacaaaggtaggaaagaaagatgaaaaaaagaatgtccaaaaaaatcagtgcaccgcagctggttacactggtctttatgatgttgatcttgatgggaactgggttgcttatgttaccagttgtaacaaatgatgggcaaggtgtgcctttcttagatgcattgtttaccgcaacttccgcgatttgtgtgacaggactttcgactttttccatttctgaacagtataatatgggcggacaagcgattcttttgatcttgatcgaaattggggggatcggttttatgtcgatcccagttttcttttatatcttagcaaaaaaaagggtcaatttaagcactcggatgattctaagagaatccctcaatcttgaccgaatgtctggcgaatttcaattggcttggtacattatccgcatcgcatttttgattcaatttttagggatctgcctgttggctctgtcttttgtgccacgctttggttggcagcaaggcctatggtttagtatttttcacgccatttcttccttttgtaatgctggatttgatctttttgggaatagtctggtctcttttcagtcggatccttttgttttaggggtcattagtcttttgatcattgccggcggcttaggctttctggtctggtttgacttgttagctacttcaaaaagacgctcgttgcacagccgtattgccttgttggcaatgattgttttgctgattttagggacggttggtttttatgtgaccgaatatcactccagtatcgtatcaggcgattccattgttagtcgctttttccagttattttttcttgctgtgacccctcgaacggctggattttatagtatcgattatggccagatgagtcaggctgggttaatgttgacgatgattctcatgtatatcggcggtacttctggatcgactgccggagggctgaaaaccacgacggtctcagtgttgatcattaagattcgcagtttgttgaaagggcgcaaacgagctgaagtttttggcagaacgatcaaagaggcggctgtttcgcgggcgttcacgctctttttcttaacactgagtctttgctttattgccatctttttattatccatcacagaatcgatgccggggaattctcagtttggactggagtacattgcttttgaagttttttcggcttttggaacagttggattaacaatgggattgactccgtatctttctgtatttggtaaattattgatcatcttattgatgtttattggtcgtgtgggcatcatgacggttgctttttcattgatgacaaaagccaaccgccgagaagccggatacaaattcccggatgaaacggtcatgattggctaagatctgttattaaaagttgttttggatcaatggaaatcatccccgaaaaatattgccgacttttaggttagtttaaggtttctcgtctaagatcttcctaagaactaaatgagtcagttgcagcatttcgttagagctgctaggacaatccaaaggtgggaagaccatgagcttgtgggaattgtggtttgtaggaaaaacttttgtgaccgtgctgctagtcgtttttttactagaatggctgtacttgttacggaaactttcaagaaaatcgcagcagttgatctatttactgctgattttggttgaatggcacagcaacggctggatcgggctcctaacaagtttagtatgcggaacgtattttttcgggcattggaaagagcatgctgatacgactgcatcgattcaatcgacagtgtatggtgatgggcaagagggtactgaaaacttgatgcaaaaatactagcatggcttgggtcaatgggaactattgccgctgatatgcttcttcatagaaaagacactgctagttaaaaagaacctgtggtaaacgaaaagataacttttcgcagcacgggttctttttgataggattcagtgagtgatttacgccgttttgcttactacgtggaaatagccttctttgtcttgaatgatccagacattttgattgtcattcttgacgatgacgattccttgtacgacctcattggtgactgtgcgaaattcttctttattcatttcgatacctccaaggtagattccaattattttcagaagggggcagcacgacagtagagaaaaagccgtgctgcaaagcaaaaagaaaattaattggtagctatagtatacaggcaagatattgagttctagtcaatttcatgtaaataatcggttaaaggagaatcaatctgtcaaagaaaaacgcagtttcattttggtattgcctctttccaccatttctcctagtaattgagtggcatgtgataagtaaagctgggccatttcacggttggcttcttccaataactgatttgttaatgggattgtctgatcgatcttctgctgaatcgctagacaatttgccatgattgtttgttcaaaccgttctgctagatcgctgtatagatcatagtcttgatccccgatcagtgctaatgttttagtcaaccaatagctatttcccggatcgtaagtagtggtggtatcacaataacctttcggggtctcattcacattgctgtaaaaagggaccactccattgaaggtattgggaccaaaagctaaccagtgaacgcctgcaatttcatcaggtacgtgactgcgcacttggagaatatgcacttgctgattgcgattgagagcaatcgaacgaaagcgagttctctcactagccgttccattcccgtacggatcataaggggtattttgaaaatgactgctcaacgcccactttacatccatcacgctgattttctttttcggaagacagatgaaaggtagatcttggtcaagcggatccgacgcggtttcgctgaactgtttttggatataccaagctctagggttgttataacgagtatctttttctgttgcactgccgaaaatatgacgtaaattgattccttcaaagtctggatttaagtgattgctgacaatcatatcaggtaaatcgtcggaaaataaagtatcttgcgaatcaaaatcgaaggtagcgatattcattcgattcggggcgatcacataagcatcatcaggaattcggatcgctgcccaatgatgtccgccaatcgtttccatataccagatttcttctcgatcggcaaaagccaaaccattagactcataggtaccataagtttctagtaactcgcctaagcgtaagactccttctcgagcagaacggatatagggaagcacgatactgacaaaatctgcttctccaatgccttcttttaccaaaggatcgatagctaaaactttcgcattggtagtgatcgtttctgtggcggtcatggcgacattggcgctgttgattcctgaagcagcccagactccttgagattcatctgcctcaggcgtagaagtataccttaggggatctttcggtaaaggaatactgcacccgcttaaaacagcatggaacgtagcaggctgttgttcaggctggattacgacaaatttttgtggtagggacactgccccggcatcttcattgcgagcaatgagggtcgagccatcgagtgatgcgtttttgcctaccagcatggttgtacaagaagctgatttgcgtgtcattgacaaaactccgatcttcagattattttgttgataattgaacatagtatagcgagtaaaagacaaattgacaatcaactttcgactaaaaattagttcgctttctgtgtgacttttagtaaaataggaaagaaggagtgaagaaaatgaaacgaatcgttatttttagtttgctgtggctggcagggattgggttgagcggctgttctgaagctactacccagacaacaacgactggcagcaatcaagctacagctagctcggtggttaagcaacagacggctgagatctcatttgtgaacaagacagatgcgcagcctgaacaaataccagccaaaacggtgtcattcaaagaaggaacctctttaatggagataatgaaggaaaattttgatttagtggaagacaaaggcatgatcaccagtattgaaggattagcgcaagatgaagcggctggttattattggacctatacgatcaatgacgagatggtcaataccggcgcaaaagatacatctcttaccgaaaaggatcgagtcgtttttacctatgagaaattttaaaccgacaaaaatgtctttttccgtgcaagagattgcttatcttgctttgctagtagcagcatcagtggtggggcgtacattgtttcaaccactgccaaatgtacaaccaatgaccgctattttcttattggtggctctttatttaggctgtgtcagaggactgatcgtcgcattgttatcccttttgattacgaatttttacatggggatggggatttggacgattgctcaggcagtaagttatacagtcgtgatcctcatgatgagcggattaagacatgttcccatcgttaaacgttccttgatcttgcaagtgatttttagtattttagcagggttcctttatggatttgtggtctccttactcagcgtgtatctgctaggcttaccaagcttttggggctattatctgcaaggaataagttttgatacgctgcatgctgttggaaatggcttcttttatggactacttgcgccaatatttcgacgactttttcaccgttattatccagctaaaaagctcatccattagtgcaatctgctgattcagcgctttattgcattcattgctagtgtcattgatctgtctcaaagaatgatcaatgacactggtttttatatcgatatctggcaagatcctccttgtagatgctgctacaagcataattgtgttgttctcttacaaaatcgggtattcttaacctatactggaaagggagcggtttcaatgaagtggatcgtaaaaaaagaagatctagaagcatatcggacgagattcaatgggaaactggctggctatgctgaagaagctaaagtaatggcgattcctttgccaaagtattatatcgtaatcgttgatgaagaaaaaattagtttgattcaattggatttgaactttgaacaaaaagccatggaaaccgtgctgatccatgagatcaccacattgaaaattactggtgtcatgaacaaaaaagtgttgatccagacgccttctaaaactatcaaggttttgattaaaccgatggcgatcggaatcaaagaagagcagcaacagttgatcgatacgtttacccggatggcgagctgactacttattttagaggaaaaatcaaaaacggatcaaacgccaagctggcggattgatccgttcgtttattctggggttcccacaattttgatgtattcatcgatatttttgattttcatatgtttgatcactaactgttcacgtttgttccatttgccttcgacttctagctggtacttgttgagaggtaagcgtaaaacgtaactagaaaggtaacggtctttaataatacagttgatgattttatggtcttctaataattggattccagtcagcatcatcggagtttcttgaaaaacacgactgttgactaacaatcctacatgtgtttcattcattattcgatcctttctgagaaaaataaattctcgaatattcttcttttctatgttacccgatttatctaggaaaggcaattctggaaaaacacctagcaacgcaaatcacggaataaaacaactggtgaagaggaatcactacacgattgaatggcagaaagtttttacagaaaaaagacacagaaaaaaagatacagaaaaaaagacagaataaagagatctgaaacggcgagacaaaaggaatgaacacaaagaatgaataaataagaagcacacgaataaacaaggatttttgatggcgcttaaagagaaagcgtgtgaaaacatatcatttcttaacgtttaaaaaaggcaactttttgtttgaagtagcttagagaaagggagttaagcagaaatacgttcttctagaggaaatggcacctgtaaaagaacgaggactgcaagcttgaaaacaggcatttcagcagatttctgttaaaataataactataaaagaattggaggagacacatatgaaaaaatctggattcgtagtaggtttgattggcgcggcttttggtctggcagtttataataaaatgcagaagatgactgtcaacaaagattctgttaaaggcaaagcaaaagaagctgcgggaaatgtcgttggcaacgaaaaaatgcaagcagaaggaacattggatcaggttgtcggtgcttctaaagaagtactaatggacttgaaaaattctgtgtcctctgccattggggttggaactccagacaaggtggctggtaaagccaaagaggcagcaggcgatatcacggatgatccgacaaaaaaagcagaaggctttgttgatcaagcagcagggcattctaaagaaatcattgcagatcttaaagacaaatctgagtcaatggcacaagatgtcaaagataaattcgaccaaaaataggatgtagtgagagacaggcacagagggcctgtcttttttttgtggctttttttgcaaacaaaaacaatgatcctgtcacctgaagagcgacaagaacgaaggatcgttgtgcaatgatgggatcgctgacaaaagtagtaattgatgcttgacacatgaatgtacgttcatatataataaaaatgtagatatgaacatatattcatttgtaagcaaatgatgcactaactttgaaggaggcttttcttatgtctacccactcttgcaatcattcaacaccacacacccatgcagcagaggcaagccattcccatggcaacgccccgttacgtaattatttagtaggagttattctttttattgctgctttattggtaccgcaattggtcgttaaagatttattatacagtgccgctattcttttagcagggtatcatattatttgggaagggatcgaagacaccatcaaagatacccgcaaaagcagacactttaaaccgaatgttcatttattaatgacattggctgcctttggttcagtattgatcggcaacttcaatgaagctgccttgctgattctgatttttgccggggctcactttttggaagagtatgcagagggccaaagccgcaaagaaatcacgaacctcttgaagttgaatccgacagaagcccgtctggttaaggcagatggcagcattgagaaaattgcagcagagcaagtcaaaaaaggggataggctgcaagttttaccaggggaccaaatcgcaacagacggtaaaattctctcgggaatcagcagcatcaacgaagcctccatcaacggtgaaagtgttccccgtgaaaaaactgtaggggatgaagttttcggaagtacgatcaacggtaacggcacttttatgatggaagtgacaaaagacagcagtgagacagtttttgctaaaatactctctgttgtggaatcggcacaaaacaatcaatcaaaaacagaaacccgcatcaaaaaaatcgagccgctttatgtgacaacggtcttgattttggtacccttatttattttgacagcaccctttctttttggttgggattggtcaaccagtttttaccggggactagtgatgatgatctctgcttcgccctgtgcattagccgctagtgcagtacctgctagcttgtctgctatttcaaacttagcaaaacggggcatcttatttaaaggcagttcttatcttgcaaatatgggacaaacaaaagtagccgcctttgacaaaactggcacattaacgattggtcaaccacaagtgaccgatgttttctttgctgaagaaacaactgaagcgcaccgtcaagagtgggtatcgctgatcttggccatggaaaagcaagcaaatcacccattagcggctgccatcgtagagcattttgagaaacaagaaaaggcacaaccattagaactttccgttaacaaccaaattggttccggtctgacggctgtagttgagggaaaaacctatcgaattggcaagccagcggcgacgtttgcgcattcatcatttgctgagcaacgagaaaccctggaacaatcaggcaaaacggtggttgttttttcggtggatgatcagccagttggactgatcgcattgatggacttaccgaatcctcaatctaaagcggtcatagatgaactgcagcaatctggtattcgaacagtcatgatcacaggagacagtcaagcagctggacaagcgattggtgatcagcttggagtagatcaagttgctgcaaatgttctgccagaaaataaggctcagattatccagcagttgcaaaatgaatacggtcagacagtcatggttggagatggtatcaatgatgcgcctgcattggtacaggccgatatcggttttgctatgggggaaggatcggatgttgcaattgaagtgggggatgcggtgatcatgaaaaatgatctaacacgctttacctacgcactaaagaccgcaaaaaaactagatcggattatttggcaaaatatttttttctccatgtttattgtggcattattgatcgtattgaatttgctaggcaaaatgaatattgggttaggcgtctttgctcatgaaggcagtacattactcgtcttattcaacagcttgcgcatgcttgcaccaatgagtgagacagtcgcccatacatcaaaaaaataatcaaaaaacgcttatgctgatttaatggccatccagcataagcgttcgcttttttattaaacaatgtcattgattgtacgctgcagaagagcgaggaaattggtcgatttttgctaagcgctgatcgattcgtttgatgatgccttctgaaaactcgagattccggatagaagagcgagccgcaagcaataattgtttttcttgcatcaaatcttcttggattcgatagatattggctaagcgttccacatattcataatgggtgtagtccgtctggctgatcaaaaacttcaatagatctgctgcctgcatatacgcttcttgcgtataataagtgatcgcttcccggtataacttgatttcaaattcttcgattttttgggaatttgcttttaaatcccgccattcgttgattgaaatttttttttggatatttcccaaatcgtcatacaaaaaaatcacagggacgtcattgggatgttttgtttcttgtttgatttttttcatgtcgtacctcctgcgttttttgctccgtttttactgatcatttctcgttgatacagtctattgtaaaagcaaagcaacaaaaagtctacatgaagatgtcaaaagaattgttcttttagcgcattctcatcttaataactacgttttctttgaaaatgattgattaaatccgagatccccataaaaatcaagactccgccaaaaatttggaagaacaaaagccacgtttgaaacggattgaaaacaagaatgatacctgccacaatcacgaataaactgaaaagcaaaccagtgataaatggtaagccattgcgtttttgattaaagcttgccatcaaacgcgtacagccactgatcgtgatcatgattcccaaaaagaatggtacgatcgataatagtccctttgcaaaaacgagaatagctgcggcggcaatcaaaagcaggatccccgttgtcatctgcatattcacatagccggtttgccgtttttctttgtaactggaatagaggttgatcaccccaaggcaggcaacatatccggcaactaaatagacaatcgtattaaagacactgcgaggagcaatcaaaataatcaatccagcaatcaaaaataaaatcgctcgtaataaatcgtatcgttggattttctcgaaaaaagtattcataagttcagttcctccttttttttactattgtagcggatttctttcaaaatagaaaatagaaacgcgttgtaggataattctgcttttgaagcagcaaattatttggtaagatagatgaaacaacaaagaatggagaaaactatgagtgtattaacgcttttaatgtgtctgttcacggtcgtcttgtatttgtttctcgctgtcgtccgcaaagacattcaaattgttgcagccagccgtaaaggcggaaaagcagcaattgctttcttttcattggtggtcattatagcaatgttttttatggaagaaacctttgagaaccgcttgcgaggggtcgtatctggattgcttttcttaagttttgtttttgatagcagagggttagctgaagatcgattcattattcatccactaaatattcgcgggatcttgtatcaggaagtggatcgggtggtactgtatcaggagagcaaggaccaatggatcaaaatgaatttctttcgaagagggatgcgaggaccactgttgaaattcgagcgtccaatggaagaattggtcctgtttttgacggagcatctaaatgaaggaacaccgatcgatattctagttgatcaagagccaaaaggtcattgaatttctttaagcgatcatataaattgagagaatcaattggccgggcccctttgactgcaaaagcaaagagacccggtcaattttttaatttaagggactatccagttgatttttttggcaaaattcgagtacgccgaatacaggaagcaagctaggtttctgaccgaacgttttgctattttttgtttaagaagaacagggtcttacccttaaataaagggaatatggtagaattgagtatcaactttattgttttaattgaataggtttacatacaaaggaggacgatgctgttggtacaaataaaagaggtcctcaaaaccgttttgttcgttgctctgtttgggctgttactgttttcgttgcgacaatacgtcttcactcctgtgatcgttaaaggagattctatggatccaacattgcatgatggggagcgtgtgatcgctatgaaaaacacccagatcagccggtttgatatcatcacatttgaagcccctgatgaggtgggaaaaaactacattaagcgtgtgatcggattacctggtgatgtggtggaataccgtgaagacactttattcatcaatggggcagcatatgaagagccttatctttctgcttttcgttcaaaattaaccgatggttatccactgacttctgactttacgatggctgatttcggtgttgaacaaattccagaaggaaaattgttggtgttaggggacaatcgccgaatctctaaagacagccggaccattggtttgattgatcagtcagccgtattaggagatgtcaaatttattttttggccccttaaagatttcggaagcattccgaatcaacactctgagtaagcggaagtccgactcgctcagagcttttttttaaaagaaaatttgttatactatttgttatgaagacaatggaagaaaaattgtcaacggatcaatagagagcatcaaaactgttatttttcatgagcaggtttggtagatgcaggagttgatctttacttacgatagaaacgacgataaaagtaaaggagtcttcgtatgagtttacgatttatactaggcgatggacgctgcgatcacgaacaagcgattttggacgcagctaacgcttggctggaaaagccacaaacagaagtcttttttcttgtccctaactacaataagtttgaacgagaaagagagattctgcaggcgctaaaacaaggcactggagattttgcctcgattcgagctcaagtctatagttttcaccgtctggcctggttctatcttcaacaaactggctggttgtcaaaaacggccattacagataccggtgcaaccatgatccttcgcaaaatacttctcgatttggaagaggagttgattctttttcgaggagaaatcaataaacctgggtttattcaacaactgttgtctctttatcaagaaatgcagacaagtaatatcgcaaccgaagatctgcatctcggtggaacgatgaataggagcaacggagaggatgcgttaaagttttccgaactcgcattgatctttcagcgtttcgaattagaaatggtgacccgggaactgcaagtggaacaaccgctggcactactaacacgttttctgcagcaagggtctaaacccaatgaattaatgaacgatcggcctgatctttcggaatcattatttatcatcagtggtttttcagcattttcaactcaagaacagagtgtattaaaagaattgatgaaacatgggcacgtcgttgtcgatttgcttttagatcatggatatccccaagaattaccttcaccattagatttgttctatgaatcgggccgcagttaccatcaattatttcttgatgctagaacggaaaatgtcgccatttatttggatcaaaagctttcaccttctgaagcacagcaagtgacactagagaaagctgccgcatacaatgaagtggaatccttttggcgtaaaacccagaatcagctccattatcagcagcagcaatcagtttcaccgtatctagaaatgtggaaagttggcaatcctgaagaagaagtccggcagatagctgcgaaaatccgcgcattgatcagcgagcaaaaaggagcaaaactgcgttatctagacattcaagtcttgacactgcaaccagagatctaccatcaatatattccaacgatttttaaagaatatgaaattccgttttatattgacgaagagcaactcatggctcagcatccgctcgttgaattcttgaatgccttctttgcttgtgcagattatggctttcgtttaaatgacatttttcgactgttgcgtacggaactttatttgccaccagcattccaacaacaagaagactggctggctgcccgggatgcatttcgacaattagtagacattacagaaaaccaagcactggctcataacttccaaggaaaagattggacccgtgagagagactggctcttagtggactatacattgacaggagaaaacgcatctggcatcgctgaattgacagattatacgaatcaattgcgccgctatttccgtcaagatatttttggctccttaaaaaacattcaagagacaaagacgaaccgggaagctgcaggtgctttataccaatttttactttcagcaggtgttgaacagcaattgattcattggcgagatcaagcaatctcacaagggaaactagagcaagctcgcaaccatgaacaaacatggcaagctttgatcgatcttttagatgaatttgtggctatttatggcgatgatcctttcgaacagtcactctttgaagaagtattgatgacgggtttggagaatctgactttcgggaaaattccgacagcaatcgatcaagtcaatattaatcgttttgatctagtacgacctcggcaagcaaaaatcactttcgtaccaggattgaatgagacggtgttgccaagaaggatcgaaaataaaacattgttgactaacgaagaaagacaacatctcaatcaattgtttgcgggagaaaaatatctacgcgatacgattatcgaaagtagcgccaaagagccgtttcttttttatgcgatcttattgtcttccacggataaactctatttgtcttatgcatgcaattttgatacccagcaaaatatcaaattgtccccatatctggctcgtctgcttgaatggttagatgtttctttacaagaccggggcatcttatctttaaccagtgatccagaagcctacgtcggcacgtatcggggattaatctatcagttgaataatctaagtcagcaggcaagaaaagaacgacagaatttgccggcaaagtggcaacggttcaaacaggctttattgcattcgcctgaaaaacaattagcccttagagtatttgaaagccagacccatcaaaacattccagtcccgttgtctcaagataaagccgttgctttatatgggccatccatctacagttcgatctcgcaactggagacattctaccagtgtgaatacaaatattttgtcagttatggactacgcttgaaagagcgggaaatctatggacttaactcagcgatgactggtgaatttttccatgatgcactcgatcgctttgtcaaagtattgatcagtgagaacatctcattgacgcagttgaccatggatcaacggctccaatttgttgaaaaagtgttgcaagagatttttggagaagtccgctatacattattgtccagttcggccagaatgaattttattcgttatcaactaggtaagacgattcagcgagtagcttgggcattaacgaagcaaggacaaaaaatgcacttctcaccgcaaaaaaccgaagtactgtttggacagatcgctggcgctcaagggatcaatggcatcgagctgcctttaagcagtgggggcaaactgcatgtgcgaggaaaaatcgatcgggtagatgcagcaaaaaccgaagaagagcagtggctttcagtcgtagattacaaatcaagcagtcgtgaatttgatttgacagaagcttactatggcttagcaatgcagttgatcacttatttagacgttgcgctgaatgatgctgtgcagctagttggtacagaaaatgtgcgcccggctggggcttattatttacatgtccatgatccagtcttagatggtcaaaaatcctctgaagaggaacggttgaagcaattcaaatatgatgggttgtttctggatgaaccctcattgtttccacttttggatcatgaattgtcagacagcagcaattcggcagtttttccgattcgcaaagacaaaagcgggacgtaccaaaagacaccacaagccaaaaacaagttttacactgaagaagagattcgcttgttgaggcagcacaaccgcaaaaatatgcagcaaggtgcggagaaacttctcagtggcgaaattgccttgaatccgtcttataagctgaaagacaaaaagcgcgcctgtgagttttgcccatttcgcagtatttgcgatttcgatgtgatgctgcaagaaaataattatcatcgtctagagaatttatcgaaagaagaggttttacagcgattaaaggaggaggagaatgactaagatccctctaaaaccacaaaatgaaacatttactgatactcagtggcaagcgatctttgataaaggagacaatctccttgtttctgcctcagctggatcaggaaagaccaccgtccttgtgcgacgtgtgatcgagaaattaaaagcaggaattcagatcgacgaattgctgatcgtgacctttaccgaagcagcagcaagagaaatgaaagaacggatccaagtagctctgcaaacggccattaatcaagaaagccaagagcaaaaaagacaacatttcgttcggcagttgcaattattacctaccgcaaatatctcaacactacatgccttttgtttaacggtcattcggcgtttttattatctgatcgatttggatcctggatttcggatgctgacagatgaaacggagattttgctgctgaaagaggaaatctggacacaattacgagatgcacactacgaagcaaatgatgaagccttctttcgattaaccgaaaacttcgccagtgatcgttccgatgagacggttggtgatttgattttgtcactctatgattttgcccgcgccaaccctgatccagaaaagtggctggacggtttagcggtaaattatgaagccgcggacaatttaggggagaatcacctctatcaggctcaaatcaaaccgacgttggtagaaattgccgcaacggcagagcatttgctggcagcggccaaacaatttgcagatcagtcaccattaatggaaaaagcagcagcactcgttcaagcagagatttctcaagtccaagaaattcaacgagttctggcaacagacgatctatccgtcttatatgatcgcttgactcatttgacctttgatcgctacccaagctatcggaaagaagaacaaaaagaactttcacaggaaatcaaaccgttgcgggatgatgccaaaaaactattagaacaactcaagggatattttccttatccaccagcagacatgctgcaaatgctgcaactatctgaaccgatcgttgcgactatggcagagatgaccaaagagtttttgactgcttttcaagcccgcaagctagcaaaagggttgttggatttcaatgatttggaacatttcacgttgaaaatcttattgggtgatggcacaggcagcgatgcttctgtttattaccgcgataaatttgaagaagtgctcgtggatgagtatcaggatatcaatcgactgcaagaagcgattctgtattgggttcggcaagtttcaggagaccatggaaacatgttcatggtaggggatgtcaaacaatcgatctattcatttcgcttagcagaccccactttgtttatagaaaaatatttggcatttgaacatcaaaacgggggacgaagaatcgttttagcagaaaatttccgttcgcgccgcgaagtgcttgattttacgaacttggtttttcaacaattgatggacgaacaagttggacagatcccttatgatgacgcagcggctttagttccgggatttccgagttttcctgaaagcgacgcattcattccggaacttttgctctatgaaaaagaagctgaaagtactacgaatttgattgaagacaaaacggaaggagaacttcacgtcaccgcaatcaaaattcaagaactgatccaatcccaatttatgatctatgataaaaaaagacgggcagaacgtccagtcacttatcaggatatcgttttactgactcctacccgcaaaaataatttggtcatcttagatgttttcaaaaaattcgggattcctctggaagtcaatgatgcccagaactattttcaagcaacagagatccaaacaatgatcgcattgttgcaaatcattgataatccttatcaggacattccattagtggctgttctccgttcacctatggtagggctaacggaagacgaactagcagagattcggctagcggatcgtaccagtgagttttacaaagcggtcttgacttatcaagacaaccaaaaggggactgtttccgctttaagcaaacgagtggatgattttttaagcgaattgaatcgttggcgggaagcagctcgcagactgccgatccctgatttattatgggatatttatgatacaacggcttacttggattacgtggttggcttgccagcagggcaacagcgctatgccaatttgattgcattgatccaccgagcagagaaatatgagaaaagcagtttccgaggattgtatcaattcattcggtttattgaaaaaatgcaagaaaaagataaagatttggcagaaccgttggcgacgccagctgaaaatgctgtgcgggtcatgactgtccatgctagtaaagggttggagtttcccgttgttttcttattggatacaacgaaatttttcaattaccaagactttcaaaagcgttatatttttgaagaacaacttggcgcaggtatccaatatatcgatgcttcggaaaatatcaaatatgaaacgattccttttcaagccatcaaacaagttcgtttgaaaaaagccctctctgaagaaatgcgtaaactatacgtagcattgacacgggccgagcagaaactgtatttagttggttcttataaggatcggcaggcagcctttaaagcttggcaagcggggttgacacaaagtcagacagtccttgacccggctttacgtttagttgcaagaggcagtctaatggattgggtcggtttgacattgattcgtcatccagagatggagcagttttttactgatgccagtgaacgaaaaatgacgatccatcatcctgcaagattccagatccattggtggaatcaggatcagattgatcagcaattgcaggtgcagccgccaacagaggcagttgtggctccgacaccaagtactacagccccagaaagattgctgaaccgtttagactatcagtatccttacagcaaagcgactcaaaccaccagctatcagtcggtctcagagttaaaacgtctatataatgatccggacgatcaagatattactttactggaatggcattccgcggatcaaaaattggcacctcagcgctttcgttatgttgagactgaattagctaaaccgcgttttttacaagaacaaaaaccgcaagctgcttcgatcgggagtgctacgcatctagttatgcaaatgctgccgctgactgaagtaccgacggaagcatccttagcagcttttatcgatgaattggttgaacgtcagctctttacgaaagatgttgccgacaaaattgatcaagcgagcatcgtgtggttctatcaaacagccgtggggcaaactttgatcaagtatgcaacacaggtaaaacgggagcagccattttcaatgctaaaagaagctgccactatttttgaaggatttgatgaaccagatgccgaattattgatccacgggattattgatggctatgtggagttgccagatcgaatcattttgtatgattttaagacggatgctgtatttggcagtgaagcacagattgaaaagcgcatgcgggatcggtattttggacagctaaaactgtattgccaagcgttagaacaagctttgcagaaacctgtgactgagacatatctggttttactagccgctaagaaaataatcgaatggtaggccctcgaacgggattccttacaattcgtaagcgatgtgctataatgatgcaaagaggtgatagaaaatgataaaagtggaaacagattacgccctttgtcctaaatttgaaaaagctttttcgattctagggaaaaagtggaatggcttgatcattgatgtgcttcttgaagatggcaaacaacggtttgtggatcttgccaaaaaaatcccccaagtgagcgatcgggtattggtggagcgcttgaaagaattagaacgtgaagaaatcgtctgcaaagaagacaatctttactgtttaacaccaaaaggggtcgcacttgaaaaaagtatgatgagtgtgaagcgctgggcagaaacttgggtcagagaagaagaatgcagttgatttctggcaaataattaggtacactaaggtcaatcgaatagttaaaaagcgttgatggaaactagtagtttggctgaaacaggaaagggagacttgtcatagactgaaagcaagttctgtattcgaaaaatgaatttcatttctggagcttactgaacaagaatcagtcggcagtcctgctgtcgttagtagaagtgagtgcgtggactttgtccacgaatgaggatggtaacacgagacgtcgttccttttttaggaacggggtctttttttcgtcttgacttatcagctattcacaaagaataaggaggaaaaacatgtctttacaagagaaactagagtcattgaaagaagtaacgctttcaaagatcaaagaaagccgttcaatcaatgaattgaatcaagttcgtgtggatgtccttggtaaaaagggacccatcacggaagttttgcggggaatgaaagagttgtcagcagaagagcgtccaaaagtcggcagctatgccaatgagatccgggatgcgattacacaagcgattgaggaagcaaaaacttcattagaagcagccgcactagaaaaggcattggctgaagaatcgattgatgtgacattgcctggcaagcggatgccacaagggacccgtcatgtcttgacgcaaatcatggaagaaatcgaagatatttttgtggggatgggctatcaagtggttgaaggattcgaagtcgaaaaagatcactacaattttgaacgaatgaacttgccaaaagatcatccagcaagagacatgcaagatactttttatatttcagatgaagtcttgattcggacacacacttcaccggtgcaagctcgtaccatggaaaaacatgatttcagcaaagggccattgcgaatgatttcaccaggaaaagtattccggagagacaccgacgacgcgactcacagtcatcagttccatcagattgaaggactcgtaatcgataagaatgtgacgatgggtgatcttaaagggacactagaagtcatgatgcaaaaaatgttcggggctgatcgcagcattcgtttgcgtccaagctacttcccatttacagagccttcagtagaagtagatgtcagctgtttcaaatgtgggggagccggctgtaatgtctgcaaacacaccggttggatcgagattttaggcgctggaatggtacatccgaatgtattggaaatgtccgggatcgattccaaagaatactcaggttttgcatttggtttaggacctgaccgggttgcgatgttgcgctatggcgtcaacgacattcggaatttctatcaaaatgatgtacgtttcatcagtcagttcaagggggaataaatatgttagtatcttacaaatggttaaatgactatcttgacctttctgagatctcaccaaacgagctggcagataaaatgtcagtcacagggatcgaagtcgaaggaatcgaaatgccagcagcgggattgaagaaaatcgttgttggggaagtcaaagaatgtgtgccacatccagattcagatcacttatcgatctgccaagtagatatcggtgaatctgaattatcacaaatcgtttgcggtgcgccgaatatcaaaagcggcatcaaagtgattgtggcactcccaggttcacggatcgcgggcaatgtcaaaatcaagaaagggaagatgcgcggacaacaatccaatgggatgatctgttcgctgcaggaattaggctattctgatagtgtgatccctaaagaatatgcggagggtatttattacttgcctaccgatgccgaagtggggaaggaagtctttccctatctcgatatggatgatgccatcatcgagttgtcgatcactccaaaccgggccgatgccttaagtatgcggggggtcgcttacgaggtaggagccatttatcgacaaacaccaaaatttgagaccattcaactgaatgaaagtgctgtgaaagccgcagacaagatcaaaatcagcgtagaaaatcaaaaggatgcgccagcctatcaaattcggatcattgaaaacgtaacgattgcaccaagtccgcaatggttgcaaaaccgtttgatgaatgaaggcattcgaccaatcaacaatgtcgttgatattaccaactatattttgctgctgtttggacaaccccttcatgcattcgattatcaaaaattgggcagccaagaaatcgtcgttcgccgtggcaaaccgcaagaaacgttggtcactttggacggagagacacgaacgctagatgataagaacattgtgatcactaatggaaaagaaccagtcgctttagctggtgtcatgggtgggttagattcagaaatcacacaagataccacaactgttgctttagaagccgccttgtttgacccactagcgattcgtttgacgtctaaaaaattcaatttgcgcagtgagtcatcttcccgtttcgaaaaaggcatcaatcaggctgcgatcgcggaggcttgtgatgcagccgctgctatgattgcggagctagctggcggtacagttctacaaggtgctgtcaaaggcgctgaagtgacccctaaggatgttcaagtcacgatcacattagatcggatcaatcgctacttaggaacacaaatcacgattaccgaagccaatgagatttttgacgccttaggttttggctaccaagaaaatgaaggtacctatcaagttgtggtcccacctagacgttgggatattcagatcgaagctgacatcattgaagaagtcgcccgtatctatggctatgaccgtctaccatcgacacttccaagtggtgagacagttgcggggagcttaaccaaagaacaacgcttgactcgcaaagtacgaacactcttagaaggaaatggtttgagtgaagctatcagctatgcattgacaaccgaagaaaaagcccgtcaattttgttggttagagagtcaggttacccgtctggattggccaatgacagaagagcgtggtgtcttaagaatgaatctactttcaggactgctggacgacattgcctataacttggcccgcaaaaatgccaatgttgcgttgtacgaagtggggcgcgttttttacaaaacaagtgatgaccctcgggagctaccaacagaaaacaatcatctaggactagccatcactggcgccatcaccgaaaaagattggcaagaagctgaacaaaaagtcgatttctatcatattaaagggatcttggaaaacttgtttgcaggtctttctcttacggatcagattacttatgaaaagacaacagcaatcaaagaacttcatccaggcagagccgctgctatcctcttacaggatgaagtgatcggttacctagggcaagtccatccaagtacagcaaaagcttatgatctgactgagacatatgttgctgaattggacttggatcgtttgttagcaactgataatgcagcgctcatttatcaagcagtttcgaaattcccatcagttaaccgggatattgcactgttggtggatgagaagacgtcgaaccaaacaatcctgcaaaccattgaacaagcagcaggccgtttcttgacggacattcatctatttgatgtgtaccaaggaaagaacatcgatagcaataaaaaatcaatggcctatcgattgacttttgctaatcctgaagcgacattgacagatgaagaaatcaatcaagcaatgtcgaagatcacacgtgtgctagaagaatcactacaagtagaaattcgttagtcccattgctgtgataggaaacagtgacataaaaaaagagtgatcttgaggaatcagcaagattgtagcatttgcaggggaaggtgttctcccttgctatgctacaattttttttataatggatagagtaaatattctcatggataaccacagctcgaagagttgcttttccagttttattttatggaagaaaggatcgattgatggaacaactgacggtttacgatgcacaaaagcagccaacagctgcgacgatgttgcgggatacgccagtccctaatgacggctaccgagttgtggtgtctgttttattgtttaatgaagccggagaattactgattcaaaaacgacaatccacaaaaaaaggctggcctagttattgggattatcctgctggcgggaccgtcaaagctggtgaaagctgttatcaagcggcagaaagggaactattagaagagttagggatgacactttctttagagaaaatccctagtcgtttaacagtgaaatttgaagaaggctggaatgaactctattttgttcaatggaccggcgctaaccctgaactttgtttgcagtaagaagaagttgctgcagcaaagtgggtcaatgaaaaagagtatcgcgcattgatcaatgggtataaatttattccttacttatatgcaccgatcgttttctcgcttcaaagtcatcctggggaatattttccggtctaagttcttactcgtgatggtagcttctttttgatagaaagcgattctgtcgtgattgagaaaaatgttctcgaatggtgtttgctcacatgtcaatggtagttgagcagttcgcttttttatttagggatctttaaataaaagatagtaattaaaaacaaacccaccaagcatactggtgggtttgttggttgttcatatttatgcaaagtagttgatccccattgcttctttcacttctgccaaggtttgtgctgcgacttgttctgctttttcgctgcctttttttaagaggttcatgacttcagccgggtccttagcaaattcttctcgtcgctgacggatcggagcaaattcttcttctaagacatcgatcagatagcgtttgatttttacatcgcctagaccgccttgacgatagtgctctttcaatgcagcaattttttctaaatctttgccgaagacatctaaataagtaaagaccatattgccttcgacttggccaggatctgctacatggatatgatttggatcagtgtacatgctcatgactttcttttgaacgatatccgcattgtctgccaaatagattccgttgttcaatgatttgctcattttaccatttccatcgataccaggtaaacgtcccattcctttaggcggaagaactgctttaggttccaccaatacgtcactatagatggaattaaagctatgaacgatttcttgtgtttgttctagcattggtttttgatcttcaccgacaggaactaagttggctttgaaagcagtgatatctgctgcttgtgagacagggtagatgaagaatccagttgggacaccttccccaaatttcttttgttcgatctcggctttgacggtcggattgcggcgaacccgtgccacactgactaaattcaagtaatacatggttagttccgacaactgagggatttgtgattgaataaataaagtcgagcgggtcggatcgagaccaatcgctaaatagtcaagtgccacttgcaagatattttctgacactttctgtggatttttggcattgtctgtcaatgcttgcatatcagcgatcatgatataaagttgattgttagggtcgtcttgcatctcaactcgtttttttaatgagccgacataatgccctaaatgaagttgccctgtaggccggtctccggttaatattgtgttcacgtttcatccacctctaaattcaatatatagttcatcttaccttgtttttccaaaagaaacaacttgttctactaagggtcgaaaaaaaacgatggacaaaaacctaacatgaggttaaaataatgaaggtttttctttggggatgatgtggaaattaaaactacctttacaaatagaaaaattttgagctataatatgaatcaaatcttttcaattactcatttatttttaaatatagacttggagtgtgaatgaatggcaatgatagaatttaaagacgtggaaaagtactacggcaaattccatgcattaaaaaacataaatattgaatttgaaaaaggtgaagtcgttgttgtgattggtccttcaggatccggaaaaagcacgatgcttcgcacaatcaatggattagaaacgatttcttctggtcacttactgatcaatggcaaagatcttttcagtaaagatgtcaaattgacagagattagaaaaaacatcggaatggtcttccagcatttcaatctttaccccaataaaaccgtgttagaaaacatcactttggctcccattaaagtattaaaacaaaatgaacaagaagcgattgccttagccgaaaaactgttgaaccgtgtaggcatgctggacaaaaaagattcttatccatccatgttgtctggcggacaacaacagcgggtggctattgcccgaggattagccatgacaccagaaatgttgcttttcgatgagccaacttctgcactggatccagaaatgatcggtgatgttttagacgtgatgaaaaaaatcgccagtgaaggcatgtccatgatcgtggtgactcatgagatgagttttgcccgtgaagtagccgaccggatcgttttcatggcagaaggccaagtattagaagatcgtcgcgacgtcgatggcttctttgaaaacccaagagacgaacgggccaaacaattcttaagcaaggtaaccaatcattaggaggaaagtagctatgagcaaaaaaatcagtacagtgctgctccttgtattcgcgctcatgaccttttctgcttgtaaaggccaaagtgctgcagaacgtgatgtgttagcgagcagcaaagaaagcaaccaaatcatctggggagtcaagaatgatacccgattatttggattgatggatattgcgacagctgaagtccgcggatttgatatcgatatcgctaaagcaatcactgagcatattttaggacgtgacggaagtgctatttttgtcgaagtcacatcaaaaactcgaattccgctattaaaaaatggcaatatcgatgcaatcatcgctacgatgaccatcacggatgaacggaagaaacaagtagatttttctgatgtttatttcgatgctggacaatctttattagtagccaaagatagcccgattcagggaatcgaagatttaaatgccaatacgacggttttagtcgtcaagggatcgacatcagcgatcaatatccgcaaggcagcgccggaagcaaaaatcttggagttagaaaattatgccgaagcctttactgcattacagtcaggacaaggcgatgcgatgacgacagataatgcgatcttattggggatggccagtgaaaatcccaactatcatttagttggcggtacatttacaaatgaaccttacggaatagctatcgataaaggacaagagcctttcttgaaagccgtcaaccaggcattgaaagaaatgcatgaagacggtacgtatgatgaaatttatcagaaatggttccctgatgatgcatctgggaaagttgattaaaggaggaaatttgcatgcttgaattgtttcaaacttacggcgaccagtttttttctggtttcaaatatacgattttctccagtttactggctttattctttagtttagtgattggtacattgatggcgatatttcagctgtctaccaatcgatgggtcaaagggatcgctaaagcgtatgtcgagtttttccgaaatattcctttgttgatcatcgtgatgttcttttatgtcgtggtgccgatgtattgggtgacttttgatggatttcaagcgggaacgatcggcttgaccatctatacgtctgcgtttattgcagaaacgattcgttctggaatccagacagttcctaaagggcagatggaggcttctttgtcctctggattcacttacagccaggccatgcgctacattattttaccgcaggcttttaaaatcgttgttccgccactaggaaatcagtttatcaacttggtcaaaaattcatcgattttagcaatggtagctggtcttgacattatgtatcaaggtgacttgattgccagtgaaacctttaatactttcgacacctatattattgtcggaatcttttatttgattatcacattaccattatcctatttaatggtttatcttgaaggacgttgggctgtacgctcatagaaaggagacactaaatggaatttttcgaagctttttctgccatcaatcttcggtttttgatcgacggtctccgagtaacgatcgaagtctccgtcttatcgatcatctttagttttctgattggcggccttgcaggagtcttgcgtttcactaacattccgttcttttcaaagattttaggtgtagtgatcgatgtgattcgaaacctgccgttgctgctgattattttcttcacgtactttgcattgccgcagatcggtattcgtttcaatattttctggtctgcagttgtggcattgacgatttttgaatctgccatgctctcagagatttttcgagcggggcttaatgccgtaccgaaagggcaaatggaggctggtttgtctaccggtttgagttatgtccaagtgttgcgaagtattgtgatgccgcaagcttttaaagccatgctgcctgcgatcgttagtcaattgatctcattgatcaaagatacgtcattggcagtgattatttcacttccagaactgactcaccatgctcgaattatttatggacaaaataccaattatgtattgccaatgtttcttgcgatgactgtgctgtacttcatcgtctgctatgccttatcgctgctttctcgcttcttggaagcacgtcagtataattactgatttcttgaggctgcatagaaacagtgattactagatccgaatgacctttgatgtcatgcagttgctttccttggacgagagtagccagagcatcggaggttttcggatctttttttgaccgcaataggttcattgttttcttggataaagcaatacttgaaaaatcagtaaaaaaagtccaaaatggaacttagacaaatttctttctttcattaaaaaggatggacaactatgacaaataaacaacccattggctttatcgattctggtgttggcggattgaccgttgttaaagaagcgattaagcaattgcccaatgaacatattatttatcttggtgatactgcacgctgtccctatgggccgcgtccggcagaacaagtcatcgagtatacatggcagatgaccgaatttttattgcagcaaaacatcaaaatgttggtgattgcttgtaatacggctacggctgtcgcattagaagaaatcaaagaaaaattatcgattccggtaatcggagtcatactgcctggctctcgagctgctgtcaaagcaacaaaaaaccaacagatcggtgtcattggaactgcgggtactattaaaagcaatgcgtatgaagaagcaatcaagcttaaatcacctcgttctatggtagttagcttggcttgtcccaaattcgcgcctatcgttgaaagcaatcaagcgcaatcatcggttgccaaaaaaatcgttgccgaaacactgcgccccctcaaaaataagaaattagatacgttgattttgggttgtactcattatcctttgttgcggtctttaatccagaacgagatggggagccagatccagctgattgattccggtgcagaaacagtgggtgaagtcagcatgctgttggactactttgctattgccaatacaagccaaatgacccaagaaccggaatattttttttatacgacaggttcaacaaaattatttgatgaaattgcgaacgaatggttgaatgtaccggtccattcgcaacatatcacattaggaggaaattaaatgcgccatgatggcagaaaagcgggaagtatccgtccagtagaaatcaaaacaaatgtattcaaacatccagaaggatccgtcgtgatctcatttggtgataccacagttatttgttccgcaacgatcgaagaccgagtgccgccttttttacgggactcagggaaaggctgggtgacggcagaatacagcatgctgccgcgagcaacgaatacccgtaatcgtcgagaaagtgcaaaaggaaagctgtctggtcggacaatggagatccagcgactaatcgctcgttcgttacgggcagtggtagacttggaaaagttaggtgaacgtagcattgtagtcgattgtgatgtcatccaagcggatgggggcactcgaacagctagtatcaccggtgcttttgtggctttgcgattggcgatcgatcaattattgaccaaccatgagctaacggaagatcctattaaagaacatcttgctgccatcagcgtaggaattttacctgataacacttgtgtcactgatttagactacgaagaagattctgcggctgctgtagatatgaatctcgtaatgacagagtcaggccgtttcattgagattcaaggaactggggaagaagcgacatttgatggtcagcaattgaacgaaatgctgatttatggcaagacagccattgaagagctgattgcctatcaaaaagaagcattgctgattcaagaacagccccaatacgttattcctgagaagacgatcgtgattgccactggtaatcctggcaaagcacgagaattcaccgcagtttttggtgctgctggctatgacgttcggacattgaaagattatcccgcattacctgatgttgaggaaacaggaacgactttcgaagaaaatgctcggctgaaggcagaaacgattgcaaaaattcttgggcgacctgttctagcggacgattcgggcttaaaagtggatgcattaggtggtagacccggtgtttactcggcacgttttgcgggtgaacaaaaaagcgatgctgcaaataatgccaaattgttgtacgaattaactgatatcccagatgaacaacgaacagcacaattccattgtacattggtctttgcagctcctgacaaagaaagtctcgtagtcgctgccgattggccaggcagaattggccgcattcctcggggagagaacggttttggctacgatccattgtttatccctgttggttcagataaaacggctgctgaaatgagtggagaagaaaagaatcaagtgagtcatcgtggtcaagccatcgcgaaactacgcaatgtatggcaagagtggttggaaggagaacaagcatgaaatatttaatcgttagcgataaccatggcgatcgtcaaattctcgttgatttgctagcagaattttctgggaaagtggatacctttatccattgtggagattcggaactgcaaccaagcgatcccctttggcaaacctatcaagtggttggcggaaattgtgattacagtccggaatacgaggatgcaaagattatcaaaacgcctctcgacacgatttatgtgacccatggtcatttggcagatgttcgttttggcgtgacaacactcggacttcaatcacaacaagctgatgcgtcaattgctgtatttggtcacacccaccagattgcctgtgagaaggtggggcatcgactattcttgaatccgggcagtatttctctaccgcggggacctattcaaatcaaaagttttgccatcatagaaagtactgaaaagcagtggatcgttcaatattatgatcgtacgtttaatgaaatcgctgatttgcattttatttttgagcgctaagaaagcgaaatcaaaagtaaaaaattcattataaataagcagttttacgatatctttttgatttttctagtaaaatagaaaagtagctgtgaaatggaggcattcagattgattggtcaaacagtagaaaaaatattattagaaaatcaagaaagttttttagtacctgcagaaaacgttgcaacggttctttacaatcatccattaaaccatgcgttactcgttttatcgaaagtcggctattccaagattccggtcctagatagtgaggatcatcttgttggattgatcagtttatcgaacgtggtcgaaagaatgatggacctgactgggtttagtatggacaacttagaaggcttgacggccgcagacgtgatggaagtcaatgtggcttgtatcaaagaagatggcgaattagaagacatgcttcatctcttagtggatcaggcatttttgcccatcgtcaatgaggaaaatgtctttgtaggaatcattacccgaaaagaaatcttaaaatctgtcaatcacctagcacatgaattagagaaacggtatatgctgatctcaaaagaggccagtcctacagacgaattacaagtcatctaataatggataaaaaagcaccccgaaaaaatcaggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgagaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccaaaaatcatcggggtgcttttaacgtttaagcggtcaattgacgccaatgattggcgcactaggaatggtgtagcctttagcagtcagtgcatcgattgaagccgctaaaaactcttcttttagtttccactgagttccgttggtaacatacatcgttgtccggatcgcaaaattattgttgccaaggtcgacaacaccaaaaattgctggtttcgtttggatctcttcctcgtgagcagcagccactgtttgattgacttcgtcaatgatcgaccggatatcatctaagccctctgatggcaagatacgcacatctacaacgacttgcatattggctcgtgaagtgttgctgatcgtagtgatattccgattcgggatataatggacagtcccatccacggattttaactgaaccgttcgaataccgacagctgtaactgttccttctaatgacaaattcgtcaaacggatataatcgccgacattgatttgttgctcagtaatgataaaaaaaccagtgatcagatcattcataaagccttgagcacctagtcccagtgccaccccagcaatcccagcccccgctaagagtgaaccaacaggcacgccaatcgttgacaataacgcatatacaaagaagaaacctaatgtatagtgtacgatattgcggatcagcgcatggatcgtgttgattcgactggcattataggttccttttttctcgtaggaacgataaattcgttcgatgacataattgctgattttcagcaaaataccaaataaaataatcaaaaaaagcagcatcagaactttttggatcaagataccaacaatagcctcccaatcaatgttttgccaccatttctgcaaggcattcaattgtttggcggcaggctccgtcaagctggatcctgtcgaatccgttgtagcatctgtcaaaagtcgtaacataaaatccctccatctatcaataagtctattttataggagaaaaaacagaaatgcaaaattcacttgttaaatttttgtaaaaagatgaacaaataagggaatatcattagttagcaaagaaacagcaaaaactcgtctcttggcatagaccagtcaagagacgagcacgagtacatgtgatcatagaattacgataagtgaacacctttatcgacaaaaatcacttctccgatgataccgctagacaatggactaatcagaaaggcacatgtgttgccgacttcttcgatggtcacaccaacatgatcaggagtgcgatcttcagataattggatcagcttttgataatcttttacacctgtcacagccagtgttttgattgcgcctgcagagatggcgttgacccggattttttgcggggataattctgcagctaaatagcgaacgcttgattcgagagcagccttagcaatccccatcatgttatagttgggtacagcacgttctgaacctaaataggtcaaggtaacgattccggcattttctgccaagaggggtttggcatatttagtaacagcgatcaatgaatagctgctgatatcttgtgctagtgcatagccatctcttgatatatttaaaatatcacctgaaagatcatctttgttggcgtaagcgacagcatggacgacgccatggatttcgcctgcatagtctttgatggtttcaaaagctttcgcgatactctcatcatttgcaacatcacattcaaccgtatactcattttcctctagtagccgttcaagaggttttttcatgcgttcgttttgatacgtatagatgacttcagcgccttgttcttttagcgcttgcgcacagccccaagcgatactgcgtttgttggctacgcccatcacgacaactttttttccagttaagaaactcataattccactccttaatagtttgcataataatcaataatgacgatcgatagtgggtcccactatcatgatttctaattattattcataattgtttgattgtcaaactatttttttattaataaatatttagttgcgaaaaaatcagaactatgatactttgataatcaaactataatatttttttaagcaaggaaggaaaccccatgaaaaaactattgacagaaacagaagtcatggacttgattccaaatcgctatccgatcatttatatcgattacgttgatgagattgaatcagggaagaagatcattgccacgaaaaatgtgacgatcaatgaagattttttccaaggacattttccaggaaatccagtgatgccaggagcgttgattttagaaacattggcacaagcaggttcgatcttgattttgaaatcggatgaatttcagggaagaactgcttatattggcgggatcaacaaagcaaaattccgtcaaaaagttgttcccggcgataccttgaaacttgtttttgagattacaaaaatcaaaggttctgtagggacagccaatgctgtggcaactgtggaaggaaaaaaagcagcggagtgtgaatttacctttattgttggagaacaaaaataaaataaagaccagtgcctttaagggaaattttcaaaggcattggtcttttttgcttacttagcttcttgtaaaatcttgatggatttgattttgacaggatcttttggcgtagagtcttctccgttgctattcgcctcaccggtcgtttcggctttggcaattttgtctacgacctccattccttcaatgacctgaccaaagactgtgtacttaccatctagtgtcggagcaccaccatctttgtaggcgtcaatgatattttgaggataaaattggattgctcgtccatcagagacatcatcatggttttgaacaataaagaattgacttccttggctgttgggagcgctggattttgccatcgataacgcgccgcggatatggtaaagctgtttggatatttcctcgccaaaccctttgccccaaatgctttctccaccagttccgtcaccgttagggtcgccgccttggatcataaaatcttcgacgattcgatggaaagtcaagccatcgtagtagccatttttggcatgagtcataaagttttcgacagcttttggtgcaatttctgggaataatttgattttgatcgtgccttctgtggtctcaagtgcaacaagatcttcattttcttttacttcagtagacaactgcggcagttccagagaatttaagtctacagattctgatgtggttgttttatccgaagaactagaagtagttgttgtatcattgcaggcagttaatagaaagaggctagttgctgccgccaacgttagtatcatttttttcatttgagtaagatcctttcattactagactgtctttatcatatcaaaattaagctggagtgaaaagcaggtatctattaaaaccaataggaaaggtgtagaccacttatcggttgtttgctataatgaaagaggattcatgaacaaaaaacggatagaatttttaggaggtttgacggatgggaaaattaggtatttcagtttatccagaacgatcaacgtttgagaaagacaaggcttatcttgatttagcacacaaatacggctttaagcgtgtgtttacaagtttgctgcaaatcgaagatgataaagaaaaagtattggcagatttcaagcaggtagtggattatgccaatcaattaggaatggaagtcatggtggacatcaatcctggtctctttgatcaattagagatctcgtatgatgatctttcattctttgatgaaatgggtgcttatggtgtccgtttggatatcggttttaccggtgccgaagaagcgcgtatgacgcgtaatccttatggcatcaaaattgagatcaatatgagcagtgggacaaactacgtagacaatatcatgagttattcgccaaatacgaataatttattaggctctcacaatttttaccctcatcgatattcaggtttgggttatgaccattttgtgtattgctcagaaaaattccgtcgttacaacttgaacacaatggcttttgtgaattctcacgaggcaacatttggtccttggccaacacaagatgggctttgttcgttggaagatcatcgtgatctgccaatcgctactcaagtcaaacatttggttttgacaggattaatcgatgatatttcagtgggaaatgcctatgcatcagaaaaagagttagctgcaatggcagaagccttcaatgcggactatcctaccttaaaagtagatgttgctgaaggaatcacggaagatgaacgcatctgtttgtttgataatcttcatggttatcgcggggatcgctcagaatatattttgcggtcgacgatgactcgaatttactacaaagataagccattcccagcacatgatacccatgatatgactcgcggtgatattttgatcgataacgtcggttatgggcaatacaaaggtgaaactcagatcgcattgaaagaaatgaagaatgatggccgtgtcaatgtcgtaggaaaaattgctgcagatgaactgtttctactggatttcttgaaaccatggtcaagctttaaactaaaagacagcaaagacgaataagacgctttgtttttctaaagaactgctctttttgagcggttctttttgtttaatagctttcgtccgtgcagtgtggggaaaaaaggcgcgtttctacatgtggatgagattgatggtaagaaggtgaggactgttgaaaggagccgcctgctagcaaaaatttctttactctttacttctctgctctttacatagcagcacttggtagcgcttgttgaagtgttagtttgactgtttttcgttttggtcctattgacaaatcaaaagtaaaaggggtattttgtactagaatgttttttaggagggagcaaccagaacggtgttttttattattaaaacgttattgttatttatcgttaccattcgtctggctggttttttgtcgattttcttactgattgctattttccagcaaaagcggaaacgacaacacatgaccagtgaagaatgggagacatattttaccaaattaggaactgatggctttctttggcgcttatatggctgtttttttgccgttttaggggtctttgcggtcatcaatacattttatttttggcatcagatgtgggtgtatgggatcacgttgatgttggcgggcggatttcatctttatttcaaatatcgcctgaataaggagcagattcaagcgcgtttcttgaaataaacaaccaataattatattatgtaaactagttgtcgaggaggaacaaaatgaaactacgctggaagatcgccattttagtaggggtgcttttgatagtaggcttgggctatgccggaaattatttttataattacgcagttgtcccatcagaaaaagattttttaaaaggtgatacctctggaacggacaaaagcaatgcgaatcctgaagcggaggagtggtttaccgctccggaaaatcgtcaaatgtggcaacttgaatcctcagatggattgatgttgtccggaatttacttgcctgcccaaaaatcacagcacaaaacagtgattgtcgcccatggttatatgggaaacgcagagacgatgggagtttatgcgaagatgttccatgatctaggatataacgtattggttcctgatgcccgcggtcatggagaaagccaaggcgattatattggctttggttggccagaacggaaagattatgtccaatggatcgatcaaatcttaaaagaaagcggcaaggaagaatccattgttttatacggtgtaagtatgggagctgctaccgtgatgatgaccagtggcgaaaagttgcctgccaacgtaacagcgatcattgaggactgcggttatgcttctgtaaatgaggaattgagctatcagttggatcaattatttggtttgccagcatttcctttgatcaatgtcactagtctggttaccaagctaagagctggttacttctttggcgaagcagatgccgtgaaacagctgcacaagaacactcgtccaatgttcttcatccatggtgattcggatactttcgttccttattcaatgttggcagaggtttatgctgctacagatgcgccaaaagaaaaatgggtagtcaaaggggcggaacatgcccaaagctacacgaaagatccaaaacgttaccaggaaaaaattgcggcattccttgaaaagtatgatcacttgccagaatagcaaaaaaagagcgaagatccgtagatcttcgctctttttgtaatgagtagcttataaattagcaaatttttctaacaaacgaatcatttggcaagtaaaaccatattcattgtcataccatgcaacagttttgaccaattggaagtctcctgcagtagttacttctgtttgtgtcgggtcaaagattgatccttgcgtcgtaccgataacatcgccagagacgatttcacggtcatcgtagccaaaagaaggattgtcgatcgtgtgtttcttgatggcttcattgacttcttctgcggttactttttgtttcagaatcgataccaattctgttaaagatccatcgacaacaggtacccgttgtgcgtgtccttgaagtttgccatttagttctggaatgaccaaaccaatcgctttcgctgctcctgttgaatgagggatcgtattatcagcggctgaacgcgcagctcgcaggttgcctccccgtaccgggccatccaaaagcatttgagtagaagtgtaggcatggacagtcgtcatagttcctacttcgatcccaaattcttcatttaggaaataagccattggagctaaacaattggttgtacaagaaccagctgaaatgattttgtcctctgcagtaagtgtatcactattgacattgtaaacgatcgttttcatttttcctgctggtgcagagataacgacacgttttacaccggcatctaagtgtgcttgtgctttttcttcagatgtataaaagcctgtacattctaaaacgatatccacgccattttctttcacccaaggaattttgctggcatcaggttctgcgtagacttttgtttcttctccatcaacgacgatcgcatcatctgtggcagtgactgtgcctggataggtaccatgagttgaatcaaactggagtaactgggctagcatgacggggctcgtcaaatcattgatcgccacgacttcgatatcatctgatacttctttgattcgacggaaggccaagcgaccgatacgtccgaatccatttattcccacttttactgtcataatctattgttcctcctcttttttgatcttacaattaaaattctgctacgaaaccaggattctgtcaaagaaaaacccttaaatttttatctagttctttgggaaaagaggcagaaaagatagacaaatggccttgcggtcgttacaattaaatagactttcttaaaggtgaactttggcctgcaaatggcatgaattgtattcaaattggtttattagaaggtaagaagagagaatggagggcacataacatgtccatgtttttagatcaggtaacaatcgatgtcaaagctggtaaaggcggagacgggatggttgcatttagaagagaaaaatacgttcccgatggcggaccagccggtggggatggcggccgcggtggtgatgtgattttagttgtcgacgaaggcttgcgtacgttaatggatttccgtttcaatcgtcattttaaagcacaaccaggtgaaaacggaatgagtaaagggatgcatggccgcggagcagaagatacgtatatcaaagttccccaaggaaccactgtccgcgatgcagacacaggtgctttgctaggagatctgttggagcaaggacagacgttgacgattgccaaaggcggccgtggcggtcgcggcaatatccgttttgcttcgccaaagaatccagcgccagaactagctgaaaatggcgaacctggccaagaaagaaaaattgaattggaattgaaagtactagctgatgtcggcttggttggtttcccatccgtaggaaaatctacattactttctgtcatttcttctgcaagaccgaagattggtgcctatcactttacaacgctagtccctaatctagggatggtaacgacttcagatggtcgtagttttgctgtggccgatcttcctggattgattgaaggggcatcgcaaggtgttggattaggtacacagtttttacgacacattgaacggacacgagtgattttgcacgtgatcgatatgagtgggatggaagggcgcgatccgtatgaagactatcaagcaatcaatcaagaattagcaacccataacttacgcttgcttgaacgtccgcaaattatcgtagcgaataaaatggatatgccagaatcagaagaaaatctggtgaaattcaaagagcaattagcaaaagaacaaaccgatgaattcgcagatcctttgccgattttcccaatttcaggtgtcactcgtaagggaattgatgctttactgagtgcaactgcagacttattagaagtcacaccagaattcttattgtatgatgaggaaatcgaagaagaagttgttcaatatgggttccattcggatgaaccagaatttaccattgatcgtgatccagatgctacttggatcttgagtggtgaaaagattgagaaactcttccaaatgactaactttgatcatgatgaaacagtcatgcgttttgcccgtcaattacgcgggttaggagtagacgaagcgttacgtgcgcgaggagccaaagatggcgatatcgtgcgcatcggtaattttgagtttgaatttgttgaataagattagttgagtaagcttagttgctgctttagatacagttaaagcgttagcgcctaatcctatcaataggaacaactcttgatacaactagggaatctttataaaaaagggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgagaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagcctaaaaaagcggagttatgagatgacttcgtttttttatttgttttctttttcaaatagacaagatactggtaaaataaagaaaagaaagggagcgaaaattatggcaaaacgtgtgattgtaatgaatttcaacgcaaactcggaagcattccaagcattttctgaagtaaaacgcatgcatatggaacgaaaaatcaaaggagaacaaatggctgtgatcactcatacagaatccggtgcgcaccagttcaagatcgaagattttctagactttaccggtaataacaaagcatcgactggtggaatgattgggatgctagtaggaattctgggaggaccattaggaatcatgttaggctggttcggcggtagtatgattggtgcgacacgagacgccaaagaaatccaaaatgcacaattgctgtttgaacatgtcagcacccaaattggggtaggcgacactggcttattgttgattgcagatgaggaagacaatcgtccactaaatcagttgatcatgaatcaattaggtggggaaattactcgctttgactatgatgaagtagaagcagaaattgaaacggctaaaaaagtcgaagaaaaaacgaaagcacaagcgcaagaagattggaaaaagtctcattcccaatctgaagaagaacaggaataaactataaattgcatctgaccttcgtttccgctaaaattgggggaagatgaaaggaaagaagtatatggaattagaatttttaggtaccggtgcaggcgtaccagcgaaacatcggaatgtaacaagcacagcactgcggttacttgatgaacgcaatgctgtttggttgtttgactgtggtgaaggcacacaaatgcagattttgcattctacgattcgcccacggaaaatcgaaaagatattcattactcacttacatggagatcatatttatggattgcctggattgatcagcagtcgctcctttcaagggggcgcttcaccgttagagatttatgggcccataggtattgaagaatttgtgcggaccgtgttaaaaatttctcaaacaaaattgagctacccgttagtttttcatgagatcacaaaagaaggcattctcttcaaggacaaacagtttaccgtttcttgccgtcggttggatcacggaattgaaagctttgggtatcgagttgaagaagcgagtcaccaaggagagcttcaggtagaagctttgactgcattaggaatcaaaccgggtccagtttttggtcgactgaaaaaaggcgaaatcgtcacgttggaagatggacgacaaatcaacggaagtgactatgtaggtgaagcgaaaaagggacgtaccgtcacgattttaggagatactcgcctttgtgccaattcgatcttactggctgaaaatgcagatgtactggttcacgaaagtaccttcaataaagatgaagctaaaatggctcgcgcctattttcattctacaacggtgcaggcggctgaagtagccaaacaagcgcaggtaaaacgattgcttttgacgcacattagtgcacgctatgttgggaaagatattacaattctggcaaatgaagcaaaagctgtgtttcctaatacggtgatcgtgaaagacttcgatgtcatcgatgtcccatttgcagaaaaaggagatcaagatgttgttagaaaataaagtaattgtcgtaactggcggatctgctggcttaggggaacaaatctgttatgaagcagcgcgtcgcggtgcgatcgtggtgatttgtgcccgtagaagtcagttgatcaacaaagtcaaagaacattgtatgacattaagtggcaaaccagcttatgcctttcaattggatattgcagaccctgaaagtgtcgaaaatgtcattgcttcgattcgtgaaaaggtcggaaaagtggacattcttgtcaacaatgctggttttggtatttttcaagaatttacagaaatgaaaccagaaacgatccgcaatatgtttgaagtgaacgtattagggatgatggtcttaacacagcaaattgctttagaaatggtcgatcagcgctctggtcatatcatcaatgtggcatcgatggctgggaaaattgctacaccaaaaactgcagtgtattcggcaaccaaatttgctgtattaggtttttcaaatgcgttgcgtttggagttgaaacctttcggcattcatgtgacaactgtcaatccggggcctatcgaaacagccttctttgaccaagcagatcctagtggcaattatttagcttctttagggacatttgttcttgaaccaacaaaactggcaaagaccatcgttaaagcgatgattcatccaaaacgagagatcaatcgcccacaagtgatgggagtagctgcaaaattctacacactattcccagctattggggactacttggctggaagtctattcaataaaaaataggagttgtttttgatgaaaaatcaatggcgagtaatcgtaggtattttgttggttttagtgatcgtcctttttgcggtcgccaataatatgactgttccaatcaattttggctttactagcatcaaagcgcctctgatcttgattatcattggggcggctttgttgggggcactgattatcttactagtgtcaactagtacgatgttccaacaaaagaaagaattaaaaagattacggaaagaattggctgactttcaacaaaataatgaagaaaaatttcaagaacagcgtgaggtattagaacgggaatatgcaaacaagcaagcagacctcgccttgagggaacaacaaattgctgaagcagaagcaaaaactgcggcagttgtgcctggtgaaccaccaattatagaaaatcgtcaagatacgtttccagagtaatggtaagcttgcactcttgtttttcaaaagagggttttgggactccaaccagaacggtaaatctctgaagtgaggcgcaagattggctcaccactcttttgcaacaaatgagcgaaataaaaacgacatccttcggtggtctttcgataaacgaccgaaggatgtcgtttttattgtactagaaataggatagaagctggtagtgcttttttggtcaacgcttttcttttctccaaaatatttgctataattaccaagttaggagtgattgtgtgaaacgcgcgaactttcattggctgagaccacaaaaaagtgaattatcagctaatttcgaggaaatgatccaagcaagaggtttgtcaccattaataggtcaattattatggcagcggaatattcgaacagcagcagacttgcaaagttttttagaaccggatttgcagggacttcatgatccatttttgttttatgatatggaaaaagccgtcgatagaattcagacagcgatcatgaatgaagagcgtattctgatttatggagactacgatgctgatggtattacgagcacgactgtcttaaaagaagcgctggaattattgggtgcggatgttgaattttatctgcccaatcgctttaccgatggctacgggcccaatctttccgtttatcaagataaaatcgcagctggtgtgcaattgattataactgttgataatggtgtatctggtcatgaggcattggcttatgccaaagaagcacaggtagatgttatcgttacagatcaccatgagttgccaccagaattacccgatgcgtatgccatcattcatcctcgccatccattaggaaattaccctttttcagatttggcgggtgtcggagtcgcattcaaagtcgctactgcgttattagaagaagtgccagtcgaattattagatctcgtggcaattggtacgatcgccgacatggtgtcgctcactggtgagaatcgcattctggtcactaacggattaaaaatgatccagcaaaccgaacgtgcggggctctcggcactgatcgaagtgagtggtctgaagaaacgggcaatcaatgaaacggatattggttttgccatcggacctcgtttgaatgcgattggacgcttggaagatgccaatcctgcggtaacacttatgtcgacatttgatccagaagaagcccaattgttagccaatcaattagatacgatcaatcttcaaagaaagcaatatgtggaaacgattttgaaagaagctcagaatatgctttccgattcaaatcaagtccatttaattgtgggagatgattggcatgaaggtgtcttagggatcgttgctggacgattgatgcaacagactggcagaccggtccttgttttaaccaaaaaaagcaacggtattgctaaaggttctgggcgcagtgttgcagcattaaatctatttgacatgctctctggaatgcgtgaaatgtttaccagctttggtggacaccatgcggcagtagggctcagtgtgcccattgatcacctttcgatgctccaagaacgtatgaatcaatacgtggtcgataatcggatcgacctttctagcgggattccgttaccgattgatgaagaattgtctttagcagaaattacgacaaattttatcgagtcgctgaaaattttagctccctttggtacagacaacccaatcccaaagtttttgattacgaatatttctgctgataatggccgacaaattggtacagagaatcagcatttaaaagtcagtcttacagatggagaaaatggtcaattagatgtgatcggttttggttttggatcacagctagtagaatttgagagtgaaggattggccgttgtggggcaattatctgtcaatgaatggaacggcaagaagaaaccacagctgatgttggaagattttgaagtcaacggcatacagctgttcgacttgcgttcaaagaaaaatcggcaagggttgatccttgatgcccaaacattaggtattgctttttcggataaattgccttcagagatagaacgattttgtccgaacgttcatgtttatcaaacgttagacgatttgacagctttttttggttcaggaaattatacgcaactcgcttttctagactgtcctagcgagaaagagcttttgagaaaaatcattcaagaaatacctgtcaatcgtatctatttgattttagtatccacagaggatgcttatctggatggtgtcgggactagggaacaatacggccgtttgtttcaactgatcaatcagcagaatgggattgatattcgctataaactgccaatggtagctaactacttgcagattccagaaaaattattaatttttatgattcaagtgttttttgatttgaaatttgttacaataaaagatggcgttttgaaaaaagtccctgatccagagaataagccgcttactgagagtgtgttgtatcaacagcgacttgcaaaaatcaaaacagaagaagatttactaatgagtgatttatcaacgattcgcaaatggttgatatcttaggaggaaaaaacatgaatttaaaagactatattgccagcattccggattatccgcaagaaggaattgtctttcgcgacatctctccattgatggctgatggagaagcttatcgttatgcaacacagcaaatcgtcgagtacgctcaggaaaaagggatcgacatggtggttggacctgaagctcgtgggtttattgttggttgtcccgtggcgtatcaactgggtgttggttttgcgccagtacgtaaaaaaggcaagctacctcgaaaaacgattgaagcaacataccagaaagaatatggcgtggatattttgacgttacacgaagatgcgattaaacctggccaacgggtattgatttgtgatgatttacttgcaaccggcggcacgattaaagcaacgatcgaacttgtggaaaaattaggcggcatcgtagttggctgtgcttttctgatcgagttgatggacttgcaaggcagagacaaaatcactggatacgaaattaaaacattgatggaatattaatcgaaaaaagccagatcaattttgatctggcttttttttgtttgtttggcagcaacactgaaataatcgacctactgttcgtaatgataaaaatcatggtcgtggtaataagtttggtttctctttcgttctgcttggcggaatttcttttcatcccatagcatgaaccacagcatcatcaaagggcaaaaaatcagaactgcactgagtacgccaaaataaccaataatgatccctgttaacaacacccacaaaataaaaccaaatcgacgaactgctttcattattttcactccttataaaaatgcgaacttatgtttgtaaaactattatacgaatgtttgttcggtttgtaaagaggaaataaaaaaaatcttcgaaggttcgaagatttaaggaatcgattaaagtaagtgacggtagagaccaacgactaagcctaaaatcgttacatctggcaagatgataggttctaggtaatcattttccggttgcaaacgaatgtgatcctgttctttgaaaaatctcttacaggtggcttcatcttcatccgtcattgcaatgacaatgtccccgttttgagcactttgctgtttgcgaacgatgacttgatcaccgtctaagattccagcgttgatcatactttcaccgcgaatcgtcaacatgaacaaactgccgatgctatttgctaaatcaggcggtatcgggaaaaaatcggaggcgtcttctacagctaagatcggttcaccagccgtaacgactcctagcattgggatcgagtttggctgcacatcgattttttctaatccggaggaagtcaattcaatcgctcttggttttgttgggtcgcgtaaaatcaagccttttttttcaagcctggataaatgtccgtggacggtagaagtagaggatagctgaacggcttcgccaatttcgcgaacagtcggcggatagcctttttcagtgactcgtgtatgaataaacttaagaatctcgatttgtcgattttctgttcgttttgccaaaactgacaccttctttcatttgatagtcttagtgtaccataggagaaacgacaattcaaacaaatgttcgctttttgttgctattgtttttttgtcaggttttgtataagataaagtagtgaaaaggaggtgtcgaaatgttatccaaagaaaaattagcccgcattaatgagctagccaaaaagaaaaaagtgcaaggtctatctgctgatgaaacgatcgaacagcaaaagcttcgcgaagaatatttacaagcttttcgtggaggaatgcgacaccacattgaaggaatgaaaatcgtcgatcctgaaggacacgatgtcactccagacaaattaaaagaaattcaaaagaaaaaaggattgcatggcagataaagatgaattccttttcattcctattgaaatcctgaaagaaatcccgtataatatgagatgtaataaaggtaaaaaaaacctaaattaggaggaattaccattgtttgataaaatcgatcaattaggtgtcaacacccttcgtacattgagtatcgaagccgtacaaaaagcaaattcaggtcatcccggtctgccaatgggggcagcgccaatggcgtatgccttgtggaccaagcatttgaaagttaatccgaccacttctagaaactggatcgaccgcgaccggttcgtcttgtctgctggacatggttctgctttgctttacagcttactgcatgtttcagggtatcaagtaaccacggaagacttgaaaaatttccgtcagtggggcagccgcacaccaggacacccagaagttgggcatacggatggtgtggaagcaacgactggtccattaggacaaggaatcgcaatggccgtcgggatggcgatggcggaaaaacatctagcggcgacatacaaccgggatgaatacaatgtgatcgaccactatacgtatgcattatgtggcgacggcgacttgatggaaggtgtgtctcaagaggcagcttcaatggctggtcatatgaagctggacaaattgatcgttttatatgattccaatgatatctcattagatggacctacttcaaaagcattcacagaaaacgttggtgcccgttttgaagcttacggttggcaacatttgttggtcaaagacggcaatgacttagaggcaatctcacaagccattgaagcagctaaagctgaaacagagaaaccgacattgatcgaaatcaaaacagtcatcggttacggtgccccaaatcaaggaacctctgctgtccatggtgctccattaggtgcggaaggtatttcagccgctaaagcaatctatggctgggagtatcctgaattcaccgtgccagaagaagtagcggctcgtttcaaagaaacgatgatcgatgaaggccaaaaagccgaagcggagtggaacgagaaattcgctgcttacaaagcggcttatccagaattagctgcgcagttcgaacaagcagtggctggcgaactaccagcagattgggatgcagaactgccaacttatgaagtaggcagctcacaagcgagtcgtgtttccagtaaagaaatgatccaagctctttcaaaagctatcccaagcctatggggaggatcggccgatctatccggatccaataatacgatggtcgcagcggaaaaagattttgaacctggtcaatatgaaggccgcaacatttggttcggtgtgcgggagtttgcgatggccgcagccatgaacgggatccaacttcatggcggtacacgcgtgtatggcgggacattcttcgtctttgttgattacttgcgtccagcagttcgcttgtcggctctccaacatgcgccagttatctatgttctgacccatgattctgtggctgttggtgaagacggaccgacccacgaaccaattgaacaattggcgagtgtacgctgcatgccaaacgtgcaagtgatccgaccagcagatggcaacgaaactcgggcagcttggaagatcgccttgcaaacgacgaataaaccaacggtcttagtgttgagccgtcaaaacctgccagtgttagcagggacgctaagtggtgtcgaagaaaacgtggctaaaggtggctatgtcctttcaaaacaaaccggtgagacaccagaaggcatcttgatcgctactggttcagaagtgaatctagcggtagaagcgcaagccaaactcgcagaagctggagtggatgtgtctgtcgtatcactgccaagctttgatttgtttgaagcacagtcagaagagtacaaggagagtgtcttgccgaaagccgtgaaaaaacgggttgccatcgaagcagcttccccatttggttgggatcgttacctaggctgcaaaggcaaagtcatcgccattgatcattttggcgcttctgctccaggaaacaaagtattggaagagttcggctttacagtcgaaaatgtggttgccactttccaatcgatcaaataagcgtaagaaacaagcgaaatcgcagctgatttcgcttgtttttttaaagtcttttcgtttttaggtagaacaagatgtttttgcgaaaagacttttaaaaaactattgagttgcttaagttgcacagaaaaaattttttccgtataatgtctatattgttgaatagtattgggacgatggaggaaaagaatgaaaaattatcaaacccgcagtgaaagacatatccaccaacaaaaagcagtgatgccacgaccaagtaaacgagcagtggtttcttttattggggctggattagcattgtcaccagcggtggtcacgctacttcccgaacaggtccaagcaagtgaatatcagaccactagtcaaggaatcgctagttttatcgaacagattggttggtcagcacaagacgttgcggccaataatgatctttatgcatcggtgatgatcgcgcaagccattttggaaagtggctatggctcatctacattatccaatgcgccttactacaatctttttggggtcaaaggatcatataacgggcaatctgtctatttgcctacagatgagtatatcaatggacaatgggtcgtaatgaatgaaccattccgccaatataattcctactgggagtcttttcaagatcacgccaacgttttaagaagtacaagcttcacttcaggtaaagcacattatagtggggtctggaaaagtcaaacgacttctttttacgatgcgaccagctatctgacaggacgctatgccactgatccaggttacgcacaaaaattaaactggctgattgaaacgtatcaactaactcgttttgatacaccaagtactggtgccacaacgacttctgtaacgacaacgacaacgcaatccacatcgacgacaacaacgacacaaagtacgggacaaagttatgtcgtagcatctggcgacagtctttgggatattgcttcacgttttggaacaacggtggatcaaatcatggctgccaatggattaagcagtgacttgatcgtcgtaggacaggaattgatcgtttgattttcgctatttattagctaaacgccaaatgaaatttcacaaaaacttttgtttttgttctcttttagtaactaaaagaagcaaagcaaaagtttttttctttgtgaaaaaaacataaatatttggaaaacgctaactttttgttcgcaagtctgccgttttttgggtagaataggaatatgaactggagggattgcaaatgacaaagatttatcaatctgttaccgagctagttgggcatacgcccatcgtcaaattaaacaaggtggttggagaggattccgctgatgtctacgttaaacttgagttttataatccagggagcagcgtgaaggaccggatcgctttggctatgatcgaaaaagccgaaaaagacggctctttgaaagcaggcaatacgatcgtggaaccaacttccggtaatactgggatcggcttggcgatgatcggtgcagcgaaagggtaccgagtggtgatcgtgatgcctgagaccatgagtatcgaacggcgcaagctgatgcaagcctatggtgctgaattgattttgacaccaggctcagaaggaatcacaggttcaatcaataaagccaaggaattggctgaacaagagggctattttatgccgctgcaatttgaaaatccggcaaatcccgagattcacgagaaaacaactgggaaagaaatagagaatgcctttgaatcaaaaggattagatgcctttgtcgctggtatcggtacaggcggcacgatcactggtgcgggtcgagaattaaaacgagtgtatccagacttaaaaatctatggcgttgaaccggcagaatcggctatcttagaaggcggacaacctggtcctcacaaaatccaaggaattggaaccggctttgtacctaaagttcttgatacagagatctttgatcaagcaattgccgtatcaagtgaagatgcgatggcaacagcgagagaagtcggccgtaaagagggcttgctcgtaggtatttcttctggagcagcgatccatgcagcactcaaagttgccaaagaactgggaaaaggcaaaaaagtcttagcgatcgtcccggacaatggagaacgctatctatcgactgctttatatcaagtggaagaataacaaggaaagcgggcattggcagaatgcctgctttttctccccttttcttaaggactgtggaatttttcgtgtttgttttgtggttgattaagaatttttagagaaagctgtttgaatttttaccatctacatagtatgatattacagataagagaattggaggaactcctgtgaacacgatatatgatgaggcaatcaaacaattaaaacaagaaaatatccgtatcactccacaaagggttgcgatacttgagtttttggctagccacgcatcacatcctaccgcagaagaaatttaccgagcgatcgaagtccactttcccggtattagtgtagcgacagtctacaataatctgcgactgtttacggagatcggttttgtgaaagaaatgaactacggcgatgcatccagtcgctttgactttaagacagagccgcattatcatgcaatttgtcaacgttgcggcaagatttctgatttttactatcctggattggaagatgtcgaaatggccgcttcccaactgaccggatataaaatccaaagccatcgcttagaagtatatggattgtgtccagagtgtaaaggagaagaggaatgaaaattatttcaacggataaagcaccgcaagcaattggtccttatgtacaagcacggattgctaatggtttcttgtttgcttccggacaagtgccgttagatcctgttacaggagaagttgtgggagcaactatcgaagttcagacacagcaagttctcaaaaatatcgaggcaattttaactgccgccggtattacaccagatgaaatcgtcaaaacaacatgtttcttaaaaaacatggatgattttgttccattcaataatacatacagcacactttttcatgaacatttgcctgcacgttcagcagttgaagtggcccgtttaccaaaggatgtattggtggaagtagagatcattgctgtggtggcacaataaaggagtcaatgggacggtcgtatatatgcgcagtcccatttttgttgagaatggattttattcttgatgatgccaaaataaaattgaaaatggtttttatgtaacgatgggaaaagaggacaataagatgatttctttacaagaatatttagcccaggggcaaacaactgtctccaatctgcttttggaaaactatcatagccttggtttaaccaatgatgaatttgtattatggcttcagttgtatcgttaccacgaacaaggcaatgattttccagatttagcgatgattgctaaagggatgggaagtgagcaaaaagaaatctataaatggttgaatgagctattgaataaacagatcatcgccatcgaatccaagaaagattcagcagggaagatggtggattactatgagttttctggaatctatgaacgactggaagtttgtttgcggcaaaaaaatcagcaggaggaaaagcagagctatgattcaaaagtacgttcgctttatcaaatgtttgagtccgaatttggccgtccgctttcagcaatcgaataccagcgaatatcacaatggctggaagaagataaataccagccggatttgattcaatttgcgttacgtgaggcggttttgaatcaagcctacagtttgaattatattgatcgcattttactttcttgggaacggaaaaatattacctcgaaagaacaagtagaagaagaacaaaaacgccgtaaaaaacagtttatgcagaaagaaaatttggaacaaacgaatggaccggttcctaagattcctatgcataattggttagaaggggaataaaggagagttgccatgatcagtaaagcaaaaactatgatcgcattggaacaaatgtaccaaatgttccccgacgctcacggagaactgatttccaaaaatccgtttgaactgttgattgctgtgattttaagtgctcaggctacggatgtgtcggtcaataaagtgacccccacactatttgctgcctatccgacacctgaggccttggcagcagctcctgttgaggaaatcattgagaaaatacggacgatcggtctttatcgcaacaaagcaaaaaatatcaaggcttgtgcgtcccagcttatcgaacgattcaatggccaagtacctagaacccgcgaggaattagtgtcattaccgggggtcggaagaaaaacagccaacgttgttttgggcgatgcgtttggtattccggcaatcgctgtggatacccacgtcgaacgagtaaccaagcgcttacggatttgccgattagatgcaaatgtcttagaagtagaacaaacattgatgaaaaaagtgccagaagatctttgggtcaaaacacatcacacactgattttctttggacgataccattgcacagctagagcgccaaaatgtgaagtttgcccattattgacaatgtgccaagaaggacaactgcggatgcgcgcaaaaaaagttcagccacctcaatgagaggcggctgaacttttttttattcaggatttgtttcatttgtccctggagtagtcgacgaagatgatggcgtcgaacttgactccgaagaagacgatggtgtgctttcactttctgacggtggcggtgtagattgtgagctttcagaagaagattcaactggtggaatcgattcttccgttgaactgctagattcaacgatttcagaactgctttctggtgttgattcaggaagcgaagaagagctgatcgttgatcttgtgctagaacttggttgctggtaagtccctttgatgtaaagctcattgccgatccgggtcaaatctgcgggcattttccagtcgcggttctcaacagaggctgagacaaattgcatcaattcccgataaacatctgaggcaacatgagtactgctgtctgtgatcggcgtcattttatcattataccctgtccaaacagctaaagaaaaggatggggtataacctgcaaacgtgatatccgggtaagcaccgtttgacgtatccaattgagccaattgattgtcatcatagttggaagtcccggttttcccagcttggtaaagtccatcgatttgggcattggttcctgttccgacagaaatcacgtctttcagaatatcggtgaccatataggctgtcgtatcatccatcgctttttgaccttccactttgaaggagtcttcatcaactgttccatcttgcgaaacgatcttattgacatattgcggctcgtaataggttccgccatttgaaaaggcagcataagcagcagccattttcaagctagagatcccatacttggtgccatcgatttctgatgtgttgctggaaattgcattggactgttcaatgtttttgtattcaatacctaggcctttcaagaaggaagaaatattgtcagcacctacttcttcaaaaagctttgctgctggaacatttctcgattgagccagtgctgtccgcaaagtgatatttcccatatattgtcgatcccagttgtagattggtgtgttcgtccccacgtaattatagggttcgtccaaaatcatgcggcctgttgaattttgtaaaaattggaaggctggaccatagtctgtcagtggtttaacggttgagccaaagtcacgagtgacgttgactgctaaattattacctaagacaacatcgtcttccacatgacgagcaccgatttgcgcgacaactttaccactattaacatctaccagagtagcggctacttgcattttatcatctgggaaattgatgtattcgtcactattaacgatgtcatacaatcgtttttgggtattgacatcaagattcgtatagatgtccaatccatccgtatagacatctttgccggtttttgcttttacttcatcaatcacttctttaaagtaattgtcataatatttccattcgttatttcgttgcggatttttttgcaatccttctgaaatatcttcggctttggctgcttcatattcgtctttagtgattttttcattctcatacatggttaacagaacaagatctcgtcgctgtttagctttgtctgggtgagcatatggatcataagcagaaggggcgtttggtaatccagcgattaatgctgtttgagccaaatctagttgatccaatgtcttgttatagaacttcatggcagctgtctgcatcccatagacaccgttagacatgtacactttattgatatagtaggtcaagatttcttgtttggattttgtttgttccagtctgacggccatccaagcttcttgcgcttttcttcgcaacgtctgatcttctgcactagtagagaagaaggatagtttgatcaattgctgtgttagggtactcccaccttgcatgccaccagtcgtcacgttcgacaatgccgatccaatgatacggatagggtctactccaatatgttgatagaaacgacgatcctctacagatacaatcgcatcttccaattgctgcggaatttcattcgcagtgattttttcacgggtctcgctaccaaaatcgaggatcagatctccgtttgaggcgtagaacctggaggaagcagcagaatcgagctgtttctcatctaatggtggtgcatctttagcgtaccaccaaaaaagtcccatccctgataagagaccgagacatcctaaaaagaagagccccataaaggtacgaagtaaaatactgccaatcgttcgttttcctttcggctttttttgtttggggcctttatatgcagccgccgctttcttagaatcatgtcgagaagctctcgattgcgattctttcgccatactaatcattctccttcattgacaaaaattgatctactgcttttaaataaggaatacgcggagcgattcctgggatgatctcaatgccgtttttctctatataggcaagaggcagcgattttttacctgttgttttttgttgatgccactctgtgatcaagttgctgctcgtcaaaaaaaagcagcgttgcaagcttgagaaccataacaagacaaagcagactccttgctgcgtcagacagttttccatatgctgaatctgatgctcatgaaaatttttgaaggggaaagaggttttgttctgtgtctctttggcttcaaaatccaagtaatatccgcgataaacaccattatagtccgtggtagaggcttctcggaagtaagcttctttaatcacagctgcactgcggcggggataatccaccttaacgatctgaacaggtgtaggttttttatgaatgactgctgcttgacgattcaaataataggcattgctttgattaattgcttcttcaaaacgcattccgcggttcgcgaaagtttttggccgagctattttttcttgcaatttttgttttttaccgccatcataagcagaagactgaccgttagggtatcgaatgaccatgttattcacactcctaggcatcattataccaaaaagacgtttggaaagaaaagagatgactgcttaaacaatgaaaaccttatattttaccggctaccgcagctttgaacttggtgtatttcaagaaaaagatcctaaaatcaaaattattaagaaagtaataaaaatgtctttactttcttacattgaacaaggactggaatgggtgctgatcagtggcaatctaggagcagaaatatggtgtgcagaagtggtggagcttttgcaaaaagactatccagaaatcaaactagggatcatttatccgtttcaaggatttggtgaaaactggaatgaagcgaaccagcaaatgttgcaacgagtgcaaatgagcgctgattatgtgaatgccactagccatcaaccctacaaagaaccaagccaattaagaaatcatacccagtttctattggaacacacagatggtgcgttgctgctttatgatgaagaattccctggaaaaaccagcttttttttgaaagatgcgaagaaatatcgggaggatcatccttacgagatcgatcaaattacaatggatgatctgcaaaacgcaacatttgatagtaatttactttgatttctgagagttttttgatagaatggtctagaaagtgaaaatcatttggaaaaatcaatgaggtgtaaataatggcaaatctaatttttagtcccaaggatattcttcaacaagaatttaaaacaaaaatgcgcggctatgatccagtggaagtcgatgaatttttagacaatatcatcaaagactacgagagctacaacaaagagattttagcattgcaagaagaaaacgatcgtttgaatgcaaaaatcgatcaactttctaagaaccaagcgattgcatcacgggtccaacaagaagcgccaaaaagtcaaacagtgacaaattttgatattttgaaacgtttgtctaatttggaaaaagaagtttttggcaaaaaattggatcaagaagaaccagttacacgttcctcttcatacaacagcaactacacaaatgctgattttgaagacgataacgaaaaaacacgtcaattctaatcaatttgattgctgtggttttcgggtaattgcggcataactttgattatgctgaggaaagtccatgctcgcacaagctgagatgcttgtagtgatcgtgcctagcgaaacaataagctagggtacttgaaagagtaacggcaggaaaaatggctaaggcgcgagctatgccaaagtatccttgaaagtgccacagtgacgaagcaagacgggaaaccgtcttggtggaacgcggtaaacccctcgagcgagcaacccaaacaatggtaggggcgctttttgcacggaaatgaacggagcaaaaaggcaagtaattgcagatagataattacccaacgttttcttctccctgaggaagacgtggacagaacatggcttatagaaaatcacagcagatcagggaatccttccagcaacggaaggtttttttatatcaagaaggagaaatctatgacagaaaaagtatttgattgtgtcgcaaccgctgctagtgggttagaagcgctagttggtaaggagttgcgagatttaggcattgaatgccaagtagaaaatggacgggctcgtttcaaaggaacgttggagaccattgcaaccgccaatctctggttacgcacagctgaccgcattaagattgtggtgggagaatttgatgtatacacctttgatgaattatttgagcaagtcaaagcattaccttgggaagactttctgccgctagacgcagagtttcctgtggcaggtaaatcgatcaaatcgaagttattcagtgtgcctgattgtcaggcaatcacaaaaaaagcgatcgttaatcgattacgggaagtttatcatcgccctgcaagtgttcctttaactgaaagtggtgctttctttcagttggaagttgctttgttgaaagatcatgccatgatcacactcgatacgacaggaccgagtttgttcaaacgtggctatcgactagaaaaagggggcgcacccttaaaagaaaatatggctgcagcattagtcatgttgaccaactggcgcaaagaccgaccgtttgttgatcctgtatgcggttccggtacactgtgcatcgaagcagcactgatcggacataatattgcccctggattcaatcgctcctttgtctgtgagacatgggattgggttccagctgaagtatttgagactgtaagagctcaggcagacgaagcagccgattacgatagacaactggacattatgggctcagatatcaatggacggatgatcgaaatcgccaaagcaaacgcggaagagattggtctaggtgattccatcaccttcaaacaacaagcagtcaaagattttaaaacagacaaagaatacggcgtgatcgttgccaacccaccatatggggaacgtttaggagaagaagagacggtacagcgcttgtaccgtgaaatgggcgaagtctttcgaccattaaaaacttggagcaaatacattttgaccagtgaccttacatttgagacccactatggtgaaaaagcaaccaagaagcgcaaactatataatggtgcgttgcgtacggatttcttccagtattggggcagtcgcccaccgcgtaaaaaggagacggttgaatgaaagaacaagaatttctaaaagaattaaaagagctcgatttgctgtcacaagcaatgggaatccttggttgggatactcagacgggaatgcctgaaaaggccagcgaatatcgcagtgaagttgacagctacttgtatggcttgtatttcgaaaagaaagtcggaccaacgatccaagaagccattacttattttggtcagcaccctgatgaattatctgaagttggtcaagcagcttatcagctggtgaaagaagaatatgagctgcaaaaaaatgttcctaatgaattagcgatcgcagcttctgctgctacttctagagctcatactgcttggacgcaagcccgcaaagcgaaagatttctctttattcaaggaagcattagctgagaatatccatttgacaaaagaactgatcccttattggaaaaaaaaggaacggacaaattatgatgttcttttgaatcaatatgaaccgaacatgaccgttgaaatcttggataatgtgttttcacaagttcgtgatggaatcatggatattcgtcgccagttagaaaaaggtactccaccagatacaacgatcttatctcgtgaaatgacagaggcgcaacagcggaaattcatctcgaaagtcatcacagacttagggtatgatttttctcgcgggcggttggacaatacggtgcatccttttgcgaccggcattaaccacaatgatgttcgcttgacgactcgttggaatgaagaagatttttcgatgggaatattcggcgtgattcatgaagcaggccacggcatgtatgaacaaaacattgatgaaaaatttgaaggaacgccgatccacgaaggagcatccatgggaatccatgaatcgcaatctttattcaatgagatcattatcggtagcaatcgtaatttttgggagaaacaatacccttattttcaagagtgtgcagaaggaactttcgatgatgtttcctttgagactttctacaatgcattaaaatttacccaagcaagtttgattcggatcgaagcagatagcctgacgtatgttttgcatatcattatccgttacgagattgagaagatgattttcaatgaagaagtgaatgtggaagatctgccaactatttggaatgataaatatgaagaatacttaggcgtacgtccgcaaaatgatttagaaggtatcttgcaagacgttcattggtcagggtcaagttttggctatttcccatcatacgcgttaggatacatgtatgcggcacagctttttcatgcaatggaaaaagagatcgatgtcgatgctgtattggcttctgatgattattcagagatccgccaatggttgaccacgcacattcatcaatacggggcttctaaaaaaccaaatcaattgattctggatgcgacaggagaactgttaaatccgcaatatttattggattatctgcggaaggtttatttttctgtttatcaaatccgctaatgagcaagcctttcgttcactcgaaaggcttcttctcatctttaaaaaaaccgcacgggaaactagttagctagacgatagtctttattgactttaggttctgatactttgatggaatcggacgattgaatcagaatgctagcaatagaaacaagataaaaaagacaggagtttcaaaaaatggctgatatagcaccaatttatgaatatgccaaattgattttgggaactgatcacacagggcatggctttgatcatgtcaagagagtagccgcaatggccaaacagatcattgccgaagatcaactgcaagtagatgattatgttgtggaagcagcggcatttttacacgataccatcgatgataaggtggtgaaagatgtggtgaaagccaaagaagaagtgcagcaatgccttctcgctgctggagccacagcagaacaaatcagtcatatatttacaatcattgagaatctctctttctcaaaagagttactggcaggggcacaagtctcctctttagaaggacaaatcatgaaggatgcggatcgcttagatgcattaggcgcaattggtattttgcgtactagttactttggcggtgcacatcagcatccgatccatgaatcagagcgagcgccgaaaacgttcacaaaccacgctgactaccgaaaagggaccaccgtgatcaatcatttctatgaaaagttgtttttattgcctgaaaaaatgcacacgcactttggtaaacaagaagcactgcggcgtaaagactttatgacaacctttttaactgaattttatagagaatgggatgtttagtaatttttaatcttcagttcgattcctttgtgtttcctctgtatttatctataattataaataaggggagagatggatatgtattacaaacaagcgctgaaaccgaatgaattattacctgcactttctgattctggggaatgtttttttatcattcgagcagcattacccatccggaattatcaagttgccatttaccggtacgatgatgagtattttttattgcaagatgaacgtttatttaatcagatctctagtatttccagggaacggcaaggagatgaagaacagattctgccattcattgaagaagcattagaagacaatcactattttctagtggaaaaagagtttatccgcttggatttattgacgctacaaaaaatgacaaccattcaatcgtttgaaatattgttttacgaattctttgatttttgaggtgatgggtgatgaaaaaaacggaatacctaaccattgaggatgcagcactcgctgatttatttcttgatctgggtgataagtacagcaacctcgaattgattgacgaagaaaaagatttggatgtggtcgttttgtcaaatagcgactggcaatatcttttggaacaactggatgatgaagtcaaggagcaatttcttgcacagaccgagactgattttctagacgaggagtaagaatagaggggcaaatgcccaatgaatgtatgtaggttaaagaaaaacagaagaacacaaaacaaaaaaatatccgaacgatagtcgatgaagaatgcgatgcgcttaacttaagtccgcatgcatgtaagtacgcttgatcattcagctatcgttcggataattgttttgtttgacggattcatttgtttttcagagcgcctgtcagtcaacatttgaataaagtgaaactgtatctttttcatttggattggagacgtacttttttgattttagcataaccccgaaaaatattgcggatcactaacaagagaccgatcagcaacggaatagctaataagtagagggaatagccatggacctgctctaccgcagcagcattggttttatttacttctgtcagcgcctgttggatcacttggaaactgaatacactcataaatccagcaatgataaagagtacaaaccctaaataaggaatatgagaagaacggcgaaaaagcgcaaagccgatatagagcaataaaagaaaaaatggcacaccaaaagcaaaataaggattcaacatgtttttttacctccttttatttatcatactccaaaatttacgttttgggaattacagtgtaagattaaaaggaaatagatttttaggaggatgttatgtcagcttatcttatgccaatcaaggttgcattactgttatttccattcttggcacttgcaatctcgtcgatattttttgtgcgccaataccgtaaatttggccgatttattttttcacgagcaattgtactttattcatttgttttttatctgctttgtgcctatttcttggtcattttgccgttgccgagtattgaagaagtcgctcaaatgaccggtcccaaaatggagtggcagttaggtgcttcctggcagcattttttgcagcaaacggtgttacaaatcaatgatcccactacgtatcttccggctttgaagcaaaacgtagtcttagagccattattcaatctttttttgacactgccttttggtgtctatatgcgctactactttaaattgtcttttccgaagacgattgtggcaacctttggcttatcactgttctttgaattgactcagttaactggattatactttatttatccgcgcccttatcggttgtttgacgtcaatgatttatttgtcaatacccttggcgggaccattggctttttggtgacgccattgttcaccttcctgttgcctacccgtgaagagatggatgccgaatcttatgccaaagataatcgagtgacgtttactcgccgatttgttgcttggctgatcgattggggaatattgaatttattcgcttggatgcttatgattctgttaagagtgactgtgaataaagaaatcgatgactttacgaatgattattggtattttttactagaagtagttctttactttattcttttgaattatattctcaatggacaaacgctaggaaaaaaacttgttcgcattcgagtgatggaggaaaatcattcccgtgtcagtttcagagcaatttttaagcgttatggattgctctatctgatctatgttagtgcgacacgcatcaatgtgttgtttacgccttttattcaatctactaatcaaatgctcgtcctagtgagtttgttggttgtgttgatttttggtttgatccaacttggattttattgcaacatcctttgggcagcattcaaaaaacaaccgcgattcttttacgaaaaaagaacggctacttatgtagtaagcacgatccagcgaaacaaggttaggaattgagctggaaatatgctataatccaaaagatgtcaatagaaagaaggtgtttgaatgtcttttgagtcatttaaatttcaaccatttatttacgaagcgttagcggagaagaaatttacttcaccaacagaagttcaagaaaaattaatccctgtgatccaaaaaggtcgcagtgtcgtgggacaatcccaaactggaagtgggaagacgcatacatttttgcttcctttgatggatcaaatcgatccgcaaaaagatgaagtgcaagtcgtgatcactgcaccgagtcgtgaattagccacgcagatttatcaagcggcaaaacaactagcagaatttcagcaaccagagattcgtgtgaccaactttgtaggcggcacggataaacaacgacaaatggaccgcttgcaaaaccagcagccgcagcttgttatcgggacaccgggacgaattctagatatgatcaatgaacaagcactggctgtgcatacggcacgagcctttgtcattgatgaagcagatatgacattagatatgggctttttggaagaagtggaccaaattgctagtcgattgccggaaaaactgcaaatgttagttttctctgcaacgattccagaaaagctgcgtccatttttgaaaaaatatctcgaaaatccattgatcgaagaaattcgtccgaaagcagtcatctctgaatccattgaaaattggttgatctcaactaaaggaaaagataagaatcaattggtttatcaactactaacgacgggacatccttatttggcgattgtttttgccaataccaaatcccgagtggatgaattaaccgactatctgaaagaaaaagggctgaaagtagccaagatccatggcgatatcacaccgcgagaacgcaaacgtgtgatgcgtcaggttcaaaatttagagtatcaatatgtagtcgcaactgatttagctgctcgcgggattgacatcgagggagtttcgcatgtaatcaatgctgagattccggcggatttggatttctttattcatcgtgtgggacgtactggacgtaatcagttagctggaacagcgatcactttgtatgatcctagtgacgaacaagccattcaagcaatcgaagatttaggtgtaaaattccaaccaaaagaaatcaaaaatggggagatcgttgcaacatatgatcggaatcgtcgacaaaaacgtgaaaaatcaagagacgaattagacccaacattgattgggttggtcaagaagaaaaagaaaaaaatcaagcctggctacaagaagaaaattcaatgggctgttgataagaaaaacaaagagaaacgaaagatcgaacgtcgtcagtcgaatcgctctgctcgcaagaataaaaaaaattccagtatctaatttaaggaacacccatcggccaggcaatggctattgggtgttccttcgttttagcaaagatttttttccatttttacacagaggattccatcttcttcaaaaggaggagagaggatctcatagccgcatttttgataaaagccgactgctgcaatttcagaagacaaaaccgaccagcaaaagccattggtgatcgctttttgctcataggccgctaacaactgccgtcctatcccttgctttcgatagtttttagccacgcaaaagcgatcgggctggatcgtttgcgaatccaacgattgatagcgaatagtggcaattggtacttggccttctgccagtagaaaataatggcagaactgatctttttgatcaaattctaattcaggagcgattccttgttcgtcgacaaagacagatcttctaagtgcaaaaacagcctgctgaatccagtcctcccgcccaaaataaagctgcatcatttttcctcccaattcatggtatactcaatctatattgattgtagcagatgaaaggggaaagctcgtggattttttcgaagcattgcaatggacgaattggaaaaatttgactgctgaagtcaaaagccaagtgtttcagcaagtagtcatgtactttgtcagcccattgaaagaaattacagatgttcattttattaaaacaagctatgcaggaatcaagtgtgagacctttgaattaacgattgatgaggaacccttcgtctttgtgcctggaaattatgaaacaattctaggctgggacttgggcattcagggattgccgataacctgctggtctaaaatgtggcaagaacctctcagcccttcgctccgtcgcttgatcaaaggctacggattgtcaaacgctgaggagtggggagattttgtaaatgaatcaatgagcccattacgcaaagcgaccatcccacccatgttggtgcagaaaatggcattgccagcaggtactcgtttgattggagaactagatacagtcacgggagaattccatggtcatgttgatcaatttgaaacttttggttccgagatacggcaggcatttcagcagccgcgaagttttgaagaaagtttgcagtgggaaatgccaagaacaatcagtgccgaaaatcagtactttgcggaactgtatccagtgtctggcaattatcatgtatacacccaccaacgaatgacccaaaatgaattgcagcactggctgggacagcagggatatgatttgatgaatgaagaacagtgggaatatgtagtgggcgccgggacccgtcgtttatttcgttggggcaatgaaaaaccctgtgaggatggtgtcaaattgaccaaaaaagcattggctgagccgaacatgtttggcttgatttatccgtatgccaatggatgggagttaactgacagttcatttctaaagatggaagattggccagagtgcggcaatccattactggatacattgccctatgctagttattatcggtcacgcaaaatgttgcaagcaaaccagcagttggaccctgaaaaataccgctaccgaaaagcagttattattgatcgagaacggatttgaggattgactttttgtgaacatttccttatacttttaaagacgaaggacatggttgatttgttcattctttacagaaagtttttcaaagctgagagaaaaacaagaatcctaattgatcgctccctttggtatctgattcagtagaaatgctgacgcctgctctgcgttatcgagtctgagaggtaatgatcaacatcattgcaagtaaggtggtaccgcgtagctacgtccttgctctgcagtggtgtttttttgtttgactacccagaagcgagttcgtcgaatgaacagatatcagagagaaaggtcaccaaagaacaaaagcattccttgctcccaagcgattttatcattagaaagtaggaaaactatatgaaacacttatcaagtgccgaagttcgtcaaatgtttctcgatttctttcaatcaaaaggacattcgatcgagcctagtgcatcactcgtccctgtaaatgacccaacattgttgtggatcaactcaggtgtagcaacattgaaaaaatattttgacggtaccgttgttccagaaaatccgcgaatcaccaatgcacaaaaatcgattcggaccaacgatatcgaaaatgttggtaagacagcacgtcaccacaccatgtttgaaatgttaggaaatttttcgattggtgattacttcaaaaatgaagcaatccattgggcgtgggagtttttgacttctccagaatggatggcctttgatccagaaaagctttatgtcacagtgtatccaaaagacacagaagcaaaacgaatttggcgcgaagaaatcgggttgactccagaacacatcgtagagatcgaagacaacttctgggatatcggtgctggaccttgtggaccagattcagagattttttatgaccgcggacctgagttcaacgatgtcgcagaagatgatccggagaattatcctggcggtgaaaatgaacgctatttggaaatttggaatttggtcttttcagagttcaatcatcaagcagatggcacgtatgaaccattaccacataaaaacattgatacggggatggggcttgaacggatggtgtcgatcatccaaaatgcaccaaccaactttgaaacagatctctttatgccgatcatcgaagcggttcaagaattgagcggcaattttgcatatggtgaaagcaaagcaacagatatttccttcaaagtgatcgccgaccacattcgcgcgctttcttttgctataggcgatggtgcactaccgtcaaacgaaggacgcggatacgtgttgcgccgtttgctacgccgcgccgtcatgcatggcaagaaattaggtatcgattcagcctttttatataaacttgttccgatcgtaggaaaaatcatggagagttattatccggaagtattggctcaacaagcgtttatcgaaaaagtaatccgtaatgaagaagaacggttccatgaaaccatcaatgaaggattagagatcttgaaccaagtcattgctaaagtgaaggcagatgggcaagagacattagcaggtgccgatatctttaagttgtatgatacttacggattccctgttgaattgactgaagaagtcgctcaagatgaagggttgaaagttgatcatgccggttttgaaaaagaaatggatgcacagcgggcacgggctcgttctgctcgatcgactgagctttctatgggtgttcaatccgctcttttgactgatatcaaagtcgaaagccgttttgttggctacgaaagccttgaagccaacagcgaattgttagtgatcattcaagaggaacaattgcttgatacagtaaccactggtgaagccaaactgatcttcaaagaaacaccattctatgcagaaatgggtggtcaagtagcggacactggtactgttgttgaccaatctggtgttatcgttgctgagatcactgatgtaaaaaaagcaccaaatggccagtttttgcatactgcgaaggtaactggcaacttgacggaaggggcttcttatttcttgcaagttgatcagcaccgtcggaacaaaatcatcaaaaaccacacagccactcatttattgcacaaagcgttgaaagaagtgctaggtagccatgcaaatcaagcaggttcattagttgcacctggacacttgcgttttgactttagtcattttggccaagtgactgcagacgaattaagtcagatggaacaaatcgtcaatcagaaaatttgggaagctttgccagtcgtaactatcgaaaccgacatcgatacggcgaagggcatgggggcgatggctctctttggcgaaaaatacggccaggatgtgcgtgtagtcaatgtcgcagattggtctatcgagctttgcggtggcacacatgtcgccaatacagaagatatcggtattttcaaaattgtttctgaatccgggattggtgctggcgttcgtcggattgaagcagtgacgagtcaagaagcttacgcattgctgcatgaaggagaagcacagctaaaagccattgcagggatcgtcaaatcggcacaaatcaaagatgtagtcagcaaaacagaacaattacagcaacaactgcgggatctgcaaaaagaaaatcaagcactggcgagcaaactagccaatcaacaagctggcgatgttttcaaagatgtcaaagaagtgaatgggattcgttttattgctgcaaaagtaactgtcaaagatatgaatcagttacgccaattggcagaccaatggaaacaaaaagaattatcggatgttttagttcttgctacagccaacgatggcaaagttaatctgttggctgcaatgacgccacaggcaaatgagaaaggcttgaaagctggagatttgatcaagcacatcgcaccgaaagtcggcggcggtggcggcggacgtccagatatggcacaagccggtgggaagcaaccagaaggaatcgacgctgcattgactgaagtagccaattggttagccgcaaactgattctttaacagcaaatcataaaaaaatgtataacatcaagaaatatccgaactggaattgtgtgtcagagagctgccgcgtctttttataagacgttcggtagaggatcgaaacgcgattccttcgggtattttttctgtttttgcagaaattggattttattaaagagaaattttggaatagctgaagcattcatttttagaaaaatacgttttttacatgcttttagttgttttactgatttcattcggggtaaaataagaaagacgaatttacgcttggagggaatgttatgctgcgcttctttttaaagcgaatgaaaggaaacgcaactgatcgcaccatgatcggtaaacttgcgggctatctgggattgctctcaaatgcacttctttttgtcgcaaagtttctgattggactgtcggcacaatcggtctcgatcatggcagatgctatcaatagtctgtctgacaccgcctcctcctttttgacattgatcggttttcggattgctgccaagccggcggatagggagcatccctacggccatgaacggtttgaatacattagcggttttgtggtttctttactgatcacatttgttggttttcagtttctaaaaaatgcctttgaaaaaatcattgctcctgaaccgatccgtttatcaccatggttgtttattgtgctgatcttgtcaataggattaaagctttggcaaggtctcatgtaccgtcaattggcgaagaaaattgactctgcaaccttacaagctagcggacaagatagttttaatgatgtactcacaacagttgcggtcttgctctctgcattgattgaatggggaaccggttggcgggtggatgggtatattggcttgctgatcgcgctatacattttatttagtggtatcatgatgatccgtacctttatcaatgaactgctaggtgcacgtccgacagaagctgaaatccgtgagatggaggatcgactagatcgttatccaacaatattggggtaccatgatctgctcgttcataactatggtcccaagaatcgttttgctagtgttcatattgaagtcaatgaaagctggagtttgtcacaagcccatgaagtaattgatgcgatcgaacatgattttcaaaggaaccttcaagttgaattggtttgtcatcttgatcctgtccctatccaaaataaacagtaccggcagttgcgggaaaaagtcagacaaatcgttgagacgattgatccagagttaaggatgcacgactttcggattcacgaaaaacagtttgcttttgatttggtgatcccaaagcaaagaaattacacagatcgtgaactgcaagataaaatttatcaaaagattacgcatgaaatcggcacgtatgaggtggcgatcacgtttgatcatacttatttgttgtaggaggaaaatatgataaaaatggatatgagtgtggtttcgaccgtctttttggcgttgctgtttgtcaatacagttgcggcatttattactgtctttcgtaaaccgcgatcaattgcaagtgtttttgcctggatgatgacattagtctttatcccgggttttgggtttttgttgtatttgttttgtggtcgaggaatcgacggagaaatcatttataaattcagtgagcaccatcaaagcaggatcaatgaattaaatcaaatcatcaaagtccacaattatttctttccagagcatccatactcagatgacaaccatctattggaacggtattttaaaaatttagatgaatcccctttgacaaaaggcaatcaggtacaattttatacggacggcaaggaaaaatttgctgccttattttcagatatgcaaaatgctgaagacaatattcatgtggaatactattctttttttaatgatgaaattggtgggcagtttcttgatgtcctaattgaaaaagccaagcaaggagtagaagttcgactaatattcgatccatggggttctcccaaagcaaatcgtaaattctttcagccattaatggacgctggcggaaaggtcgtgccctttattacttcaaaaaatttgattcgcaatacacgtttgaattaccatttgcatcgcaaaatcgtggtgattgatggccaaattggctggaccggcgggtttaatgtaggggatcaatatttaggtaaaaaagcaaaatttggttattggcgggatacacatgcgcgaatcgttggaactgctagttttaccttacaggaaatctttatccgcgattggaatgcctcgattagaaatgaagcagatcaactggaatatgaagatcgctatttcattttaccgcctaaagaagaggcaggtcatgtcgatatgcaaatcgtggccgacggacctgagacggaaacgcagattcttaaaggcggcttcgtcaagatgattttggcggctgaaaaatcgatttggatccaaaccccttatctgattcctgacgacagtatgatgaatgccttggagatcgccatccactcaggtgtagatgttcgaatcatgattccctgcatgccggatcatccatttatctatcgagcgacccaacactatgccaactatttacatcgccggggagcgaaaatctatatctatgagaatggatttttacatgccaaaactgttatgatggatgataccatctgctcgtttggaacgacaaatcaggacattcgcagttatgcgttgaattttgaagtcaatgcattcgtttatgatcaagaagtcacggcgcaattaaaaacgatttttgaagaggatatgctgcagtccactttattgacagatgaaatgctggctaaacaatcttactggttgcgtttcaagcaaaacttttctcgtttgttatcgccgatcttgtaattttaaagccttagctaacccttgacgggccagatggtcggcacctttgttttgagattcgggaatccattggacaattagtaaagtgaaatagggcagcaactcttggatttcctctaaatacttccgaaaatcggggttgttcgtatcatttttgtcgattgtttgagcgacgactttactgtctgtataaagcatgatcgtctggtcttgccattctttcgttaagagaaattcaagagcatgatgcatcgcagcaaattctgcttggtgatttgtgagcgtgggtagtacaaaggcatgctgttcatgcaggtcttcccctacaatcaacagaccgccgccactaggtccagggtttcctttggttgaagcatcgagatacacttttagcatgagttgactccttctgttatgatggatataagtatactagaaattgatcgcgtgaggaaattatttatgaaacgtaactatttttggcaaccagaaccagccaccgcaattatctattggtccagttcactgatcgttttgttttacagcttgattttggcactggaaaatactcgcccttattggaaaagcaatcttgtgttggggatttttctatttcttgtctggttaggattgcagcgccgcctttatttgacggagaagaccatcaaaatcacctatgcccgcttttggaaacgagtagttattcctctcgagaaaatccaagccattgggatagagaatcatcatttgagaatcgtgaccaatgaaagaagctatacgtttgtaatgcgtaaaaaagatcttgaagtattacagacacactttgttaatctagtgcctattcttgaaagacaagagtcagaaaaataattctggctctttttttattccagtgaaaaacagggtttcaatcttcatgaaaaacggtataatagaaataggacaaacaaatatgaaagaataagggataatagttcgggaatagagggttactgatgaaaaaagatatcgaaattgcacaagaagcaacaattaaaccgattattgacattgcagcaactatcggattacaagcagaagatctagaacaatatgggaagtataaagcaaaaatcgattggccagcaatcaaggaaatcgcgaaacgtcccaccggcaagttgatcttagttacagcgattaacccaacccctgcgggagaaggaaagtcgacagtcacgattggattggcagatggcttaaaccgtattggaaaacaaaccgtgattgctttacgagaaccatcattaggtccagtcatggggatcaagggtggtgcgactggcggaggcagagcgcaagtcttgccgatggaggacatcaatcttcattttaccggggacatgcacgcaatcactgctgcgaataatgcattatctgcgttggtggacaatcatatccaacaaggaaatgaattagggatcgacccgcgacggatcatttggaaacgtgtcgtggatttgaatgatcgcgcattaagacaagtgatcgtcggactgggcggaccactgcaaggagtacctagagaagatggctttgatatcaccgttgctagtgagattatggctattttgtgtctagcaacgaatttggataatttgaaagagcgattgagcaatattttgattggttatacgtatgataaacaacctatctacgtcaaggatttgcaggttcagggggcattagctttattgttgaaagatgccttgaaaccaaatttggttcaaaccatcgaaggaacgcctgcgttgattcatgggggaccttttgccaacatcgcccatggctgtaatagtgtcattgcaactgaaacagctctccatttaggagaatacacggttactgaagcggggttcggcgcagatctcggggcagagaagtttttggatattaaaacacccaatctctctaaagcaccagacgctgtcgtagtggtcgcaacgattcgcgccttaaaaatgcacggcgggatagataaagaacatttaaaagaagaaaatgtagcggctttagtcgcaggttttgccaacttgaaacgtcacgtgagaaacatgcaaaattatcaattgccagttgttgttgcaatcaatgaatttgtcactgataccgaagctgagatccaaatgttggagcaatgctgcaaggaaattggtgtaccaatcgctcggacgcaagtttgggagaaaggtggcgcagggggggaacttttggcgcagcaagtcgtcactgccattgatgaacaacccggcaattatcgtaggctttaccaaaatgaagagagccttcctgataaggctgccaagatcgtcaaagagatttatggcggatcaaatgtggtcttctcaagtgtggcacagcgccaattgaacgtcttcaaaaaaaatggctgggatcaattgccgatttgtatggcaaaaacacagtactcttttagtgatgatccgcagcttttaggcgcaccggctgatttttcgattacgatccgtgaatttgtaccaaaactaggcgctggttttattgttgccttgaccggtactgttatgacaatgcctggactgcctaagaaaccagcagcattgaatatggatgtcgatgcagacggcaatgtatctggccttttttaatcttattttctctccgcatctgcgaatactggatgaagaaataggttctcgaaggctccagtaatagttcagtcaatttcttataacgcaccacacttacaggtcactattgattctgtaagtgtggtgtgttgtttgcgagcgattcgtcgtctttcagtaggttttgtttggttcgttttttgttgacgctgtacataggctgcgagattcggaagagaataaaacctccctttttcttctgactttcaaaaattggaagaaataattgaagaggctgcgaggatatttgattttttgcgaagttttctaaaagtctcccatagttatctccagcattcctatttatccgtcgctcttagaaacattagaaacgaaagtaggaaacgggaaggggaaagtgttatcaagctcttttaaacgagagactataaaaagaatggttttaaaaagagggctataaaagtcgctcgtttttatcttatgatttgccgtttttgggttttcaatctattaaaagactgaaagttaaatattagcaagaggcaagagacgtgtcttttgttataatataatcagtagtgcatttaaaagactgttttctttctaagaaaattaaagtatactgataaaattggagcgtataaaacgatgaaacgtaaaatcatacgaaataccggcttttatgcaatggggagtccgctggatttgctagtggatggtcagaaagtcgccagaatcaatcatcaagaaaccgtcgagctgaatctcaattctgacaaccgattgtctgtccgattttccatcctaaaaagcaaagaaattgcgttgcctgatttacacgcagaaactccattagaaataaaaatgaatccgcgactgatttctttttatgtgctgttttatattggtctgtttctaatgatcgcgtttttaactcgcagtggacagttgtccattatcctttcgggtatctttctttatttagcaggttatctatgtttaggtctttattatagcaaacaagcgtatgtaattgaggaggcaacaaatggctagcggagcagatatttttttgagtagtttcaatcgaatcgaaaaacaattgagagacgatttgggtaatcctcgtaacatgggtttttcagagatggttcgccgtctttcaaaacagaagcaaggagacatcaaaaaatacgaagaagatttattgcagatggcccaattgcggaacgccatcgttcatgaaaaaatcggtgaaaattttgtgatcgccgagccaaatcaatgggtagtgacacgaatccaacaaatcgaacaggccttgttgcagcctgaaacggtcttacctaagtttggtaaaaaagtgaccggttttgaaaaaacgttggcgctgaaagaaatcttgaagatcgtcgctcaaaagcggttttcacaatttccactctatgacaaaggacgttttgttgggttgatcactttacgtatgttaggatactggtttgctcaagaaagtctaaaaggagagatccgattagaagggcgtaaagcagaagacttgttgatcaaagacggtaaagagtccaattatcagtttgtacccgcaacaacaacggtcactgaagtagaagacctgttccataaaaatgctttacttgaagcggtattaatcacaaaaaatggcgatcctaatggaaatttattaggcatcgttcgtccgcgggatatttttaacgaagaaagtgtggaaaaaaaatgatagctttgttttttttactaagtgccataattgttggacttgatcagtggttgaagttttggatcgtcagcaattttgaattaggtgatgttcaaacgttgatcgaccatgtcttttcactaacttatattcggaataccggtgccgcatggagtatcttagaagggaagatgaccttctttacgatcatcacggttgctgctgttattgttgtaacttatttattgatccgtcatcgtaaaagcagtatatggtttcgattgggactatcctttatcttagccggagcgatcggaaattttatcgatcgcttgcgtttggggtacgtcgtggatatgtttcagctagattttatcaattttccgatttttaatattgcagacatgtcgttagtgatcggcgtgttattgatttttatctatgcgttagttgatgatgaagtgaagggaaaataaatgaataatcaaattgaagtagtaatccatgaagaaaaagggcgtgtcgataaagtattggcagatcgtctagaagcgagccgttcgcaaattcaacaatggttgaaagaaggtgcggtcacctgtcaaggggatccaattcgtgcaaattacaaagtaaaagctggtgaccagttagtgattcaagtaccagaaccagagtccctagatctggaacctgaagatattcctttgacgattgtgtatcaagaccaagatgttgccgtgatcaataaaccgcaaggaatggtcgttcatccttcggcagggcatcctaacggaacgctggtcaatgcattgttgtatcatatgatcgatttatcttcgatcaatgatgttgtacgaccaggaattgttcatcgtatcgacaaggatacgtcagggctattgatgattgccaaaaatgatcatgcccatgaagcgttagccaaacagttgaaagacaaaacttctttacggaagtatgttgcgctggtccatgggaatatttctcacgaaaaaggcacgatcaatgcaccgattggccgttctaaagtgaatcgcaagatgcaagcagtgcaagaagatggtaagccggctgtgacacattttacagttttggaacgttttgatcaatttactttagtcgaattacagttggaaacgggtcggacccatcaaattcgggtccacatgcaatacattggctttccattagccggcgatcctgtatatggccctaaaaagactttgaaaggcaatggccaattccttcacgccaaactgttaggatttacccatccgacaactggagaatcaatggtttttgaagcgccattacccgaactttttgaggaaaccttaaaaaaattgcgaaaaaatgattgatttttttttcaaagaactgtatagtgtgtgtaacaaataaatagctcctttaagtgtagtcccgtgaggctaagaaggaaatgagcaagcagacgactcccgcgttggagcatcgaaaacttgctggatgattgcgcatattctggatcgctgtatacagcgccagaaagtatgatcggaaaacataactcctgcctcactaggcaggagtttttttatgttcaaaattaggagggaacgaaatgccaaccaaagaagtagtagatgcagtaacaatgaaacgagcattgaccagaatcacttatgaaatcatcgaacgcaaccgagggattgatgacctagtcttagtaggaatcaagactaggggaatctatatcgcacaacgaattgctgaacgcttgaaacaattggaaggggtagaagtccccgttggcgaactggatatcacattgtatcgagacgataaaaaatcagatgaagatcctgagatccattcttctgacattccaacagcaatcgatggcaaagaagtcatcttgatcgatgatgtgttgtttacagggcgcaccatccgggcagcattagatgccatcatggatttcggtcgtcctcgccggatttcactagccgtactagtcgatcgggggcatcgagaattaccgattcgggcagattttgtagggaaaaatattccaacggcattaagcgaacaaatcattgttgaaatggaagaatctgacggttctgatcgaatcatgatcaataaagaaaacgagtaggaagaagagtgacagacacatggaaaagcaagaatttcgcaataccgatgtggtattagatatcaatgatcgcccaaaggcattgccttggttaggcttaagtcttcaacatttattcacgatgttcggagcaactgttttagtaccgatcctagttgggatcaacccaagtatcgctttagtaagttccggtttggggacacttgtttacctcgttacgacgaaaggaaagattcccgcatacttagggagcagctttgcttttatcgctgcaatgcaaatgttgatgaaatcagacggctacccggcaatcgcccaaggagctgttacaacaggactggtttacatcatcgtttctctgatcatcaaaaagattggtgctgcatggctggataaaattttgccgccgatcgtcgtagggcctgtgatcatggttatcgggttaggactagctgctaatgccgctcaaaacgcaatgtacaatggggacatctatgattttaaatttatcttagttgcattggttacattgggattgacgattttcttcaacatgtttttgcgagggtttcttggcttgatccccatcttactagggatcattggtggttacttagtagctttagctgctgggatcgtagatgtgcagccaatcattgatgctgcttggttctcattaccaagcttcgaaattccctttgttcaatacaagccaacgctacatttgaatgcgatcacgacgatggcgcctatcgcttttgtcacgatgacagaacatattggccatttgatggttttgaataaactaacaaagcgtaacttttttgaagaaccaggattaaacaaaacattgatgggagacggctttgcgcaaatcgttgccggattcgttggaggaccccctgtgacaagttatggtgaaaacattggtgtcttggccattacgagagtgcacagtgtctttgttatcggtggtgcggctgtcttggctgtcttgttaggctttgtcggaaaattgagtgccttgatcttgagtatcccaaatccggtcatttctggaatcagcttcctattgttcggtgtcattgctgcaagcgggatgaaaatcttgatcgacaataaaatcaattttgaccgcaaaaagaatttgatcattgcttctgtgattctggtgatcggaatcggcggccttgtctttacggtcggaacattcaccttatcagccatggcattagcaactgtcttaggaatcattttaaatctaattttgccagaaacatcacgcagtgaagaacaataactagtcgtcaactaaaagggaaaaactaggaggtattattcatgatcatccaatcagaaagaatcagtttaaagcatcttttgaccgttgaagcattaacagatcgagaagtgatggggcttatccgcagagggcaggaatttaaaagaggggccaaatggatgccgcaaaaagaacaatactttgctacgaaccttttctttgaaaatagtaccagaacccacaaaagttttgatgtagccgaaaagaaattaggtcttgaagtgattgaatttgactcctcaacgagttctgtgcaaaagggcgaaaccctttatgataccgtgctgacaatgtcagcccttggcgtggatgtcgctgtgatccgccacggggatgaaaattattatgacgagctgatccaaagtaaaacgatccaatgcagcatcatcaatggaggcgatggcagcggacagcatcccacgcaatgcttattagacttgatgacgatctatgaagaatttggccactttgatcaactgaaagtagcgatcgtcggagacatcacccattcccgtgtcgccaaatcaaatatgcaaatgctcaaacgattaggcgccaaagtgtatttttctggcccgccacaatggtatgacaatgaatttgaagtgtatggacactggttgcctctagatgaattagtgaatcaagtcgatgtgatgatgatgcttcgggtccaacacgaacgccatgatggctcagaaagtttctcaaaagaggcttacttacgggattatggattgacagtggaacgtgcagcaaaaatgcaagaccatgccatcatcatgcatccagctccagtcaatcgtgatgttgagctggcagatccattagttgaagggctgcgttcaagaattgtcacgcaaatgacgaatggcgtgtttgtccggatggcaattttagaagcggtattgaatggcaaagcttaattataagaaacgcgaccaatagagatagaggaggaagcaacatgaaaacactcattaagaacggtaagatcatcgctgacggtgatcattgtatccctgcagaaatttggatcgaagatggtatcatccaagcgatcggaacgactttttcagaaacagggttcgatcaagtgatcgatgcaaagcaacaactgatcactccaggattagtggatgttcatgttcacttcagagagccaggatttgaatacaaagaaacgatcaaaacaggaagtatggcagccgctcgtggcggtttcactacggtttgtgccatgccaaatttaaatcctgtgccagataccgcagaaaaattgcaacaagtctaccagcgtatccaagaagacgccgtggttcatgttttgcagtatgcaccgatcacagaagaattacgtagtgaagttttaacggatcaaaaagcattgaaagaagccggcgcttttgcattcaccaatgatggcgttggcgtccaaactgctggtacgatgtacttggcgatgaaagaagcggccaaaaaccaaatggcattagtggcgcatacagaagatgactctctgttatttggcggtgtgatgcatgcgggtaagagagcagcagaattaggcttgccggggattcttagtgccacagaagcatcacaaattgcccgggatgtactgctggcagaagaaaccggggcccattaccatgtctgccatgtttcgacaaaagaaagtgtgcgggtcatacgtgaagccaaacaagcaggaatccatgtgacggcagaagtttccccccatcacttgcttttgatcgatgaagatatccctggcgatgaaggattttggaaaatgaatccgccgcttagaggtagagcagatcgcgaggcattgatcgaaggattactggatgggacgatcgattgtatcgcaacagaccacgcgccacatggctatgacgaaaaaatgcaaagttttttaaaagcaccatttggaatcgtcggttcagaatatgcttttcaattgatttatacgcattttgtcaaaacgggccgctttacactccaacaagcggtggcttggatgaccgagaagcctgctgaaatctttggattgaaagctggcagattaatggtgggagctccggcagatctcgcgatttttgatctagagacatcttatactgtcgattcggatcaattcctttcaaaaggaaaaaacacaccatttaataactggccattatatggggataccacccatacattggtcaatggaaaattagtttggcaaaaaggtagggggattttatgaaacgctggttgattttggaagatggcacattatttgaaggtgagggatttggcgcagagatcaatgtctatggcgagattgtctttaccactagtatgacagggtatcaagaaaccattacggatcaaagtttcaacggtcagatcatcacctttacctacccaatggtgggaaattacggtgttaatcgcgatgactatgaatcaatcgctcccacttgtaaaggtgttgtagtgaaagaacatgctcgtgtagccagcaactggcggaaacaattgaccttagacgaatttctaaagcgcaaaaacattccgggaatcgcaggaatcgatactcgggctttgactcgtaaaatccgccaatttggaacgatgaaagctagtattgtggatgccaatgatgaatttgctcatgcctttgatcaattgaaagcagccgttttgcccaccaatcaagtggcacaagtttcaacttcaaagccttatccaagtccaggaacaggacggaatatcgtcgtgatcgattttggcttgaaacacagcattctaagagaactttctcaacgaaattgtaatctgacgattttaccctacaataccaccgcacaggaaattttggatctcgcgccagatggtgtcatgctgaccaacggacctggtgatccgaaaagcctccctgaagccatcaaaatgattcaagaaatccaaggaaaagtaccgattttcggtatctgtttaggacatcagttgtttgctttagctaatggcgctgatacttacaaaatgaaattcggtcaccgaggattgaaccatcccgttcgagaaatcgctacaggaagaattgatttcacctcacaaaatcacggttttgcagtagcagaagcatcgattgatcaagagaaactgatcatcactcatgtggaagtcaatgatggaaccattgaaggtgtccgtcatcgtcgctacccagcatttagtgttcagtatcatccagatgctgcaccgggacctcatgatggcgtacatttgtttgatgaatttttagaaatgatcgatgcatggaaggagcagaactaaatgccaaaacgtacagatattaagaaaatcatggttatcggttctggaccgatcattattggccaagcagccgaatttgactatgcaggaacgcaagcctgcttagcgttgcgagaagaaggctatgaagttgtgctggtcaactcgaaccctgcaacgatcatgactgataaagaaattgccgacaaagtctatattgagccaatcactttcgaatttgtctcccggattttaaggaaagaacgtccggatgcgatcttgccaacattaggcggtcaaaccggcttgaatatggcaatggaattagccaattccggcatcttggatgagttggaaatcgagttgttaggaaccaaattagctgcgattgatcaagcagaagaccgtgatctattcaagcaattaatggaagagttaaatcaaccgattcctgaatcggagatcgtttcaacagtggaagaagcagttacttttgcaactaagattgggtatccaatcatcgttcgtccagcctttacccttggcggtactggaggcggtatgtgtaataatgaagaggaattgcgagtgattgctgagaatggtctaaaactgtcaccagtgacgcaatgtctgatcgaacgcagtattgccggctataaggaaatcgaatatgaagtcatgcgggattcagccgataatgcgatcgttgtctgcaacatggaaaactttgatcctgtcgggatccatacaggtgattcgatcgtttttgcaccgagtcaaacactctccgatcatgagtaccaaatgttgcgtgatgcttctctaaaaatcattcgcgcattgaaaatcgagggcggttgtaatgttcaattagcgcttgatccccacagctttaattactatgtgatcgaagtcaatccccgggtttcccgttcgtctgctttagcaagtaaagcaactggctatccgattgcgaagctagcagcaaagattgctgttgggttgacattagatgaaatgaaaaaccctgtcacagaaacaacttatgccgagtttgaaccggcattggattacgtggtagccaaaatccctcgttggccctttgacaaatttgagtccggcgaacgccgtttaggtacacagatgaaagcaaccggtgaagtgatggctatcggtcggaatatcgaggaatctttgctgaaggctgtgcgttcattggagatcggcacacatcatattgaaatgaaagaattagaacagctttcagacaatgacttgatcgataaggtgatcaaagcgcaagatgatcgcttattttatgtcatggaagccattcgccgcggctatgctattgaagaattgaatgaaatgactaaaatcgatcttttcttcttggataaaatgctgcacatttatgaaatcgaacaagaacttgctgccaacagccaagattttacaacattaaaacgagcgaagcaaaacggctttaccgataaaaaaattgctgagttatggcagatgacagaacaagagattcgagacatccgtaaggaaaatcagttgcttcccgtctacaaaatggtagacacttgtgctgccgagtttgagtcggcaacgccttacttttatagtacgtatgagtttgagaacgagagtgttcgcagtgaaaaagaatctgttttagtcttaggttctgggccgatccgcatcggtcaaggtgtggaattcgattatgcaacagtacactcggtcaaagcaattcaggctgcgggctatgaagccattattatgaacagcaatccggaaaccgtttcgacagacttctcgatttccgataaattgtattttgagccattgacactagaagacgtcttgcatgtgatcgaactggaacaaccaattggggtcattgttcaatttggcggtcaaacagcgatcaatttggcggagccattagttgccgcaggagtcagcatcttaggtacgagtatcgaagacctcgatcgtgctgaaaaccgtgatctctttgaacaagcgttacagacattagctattccacaacccccaggagatactgctacaaataccacggaagcagtggcgatcgctaatcgcatcggttatccggtccttgttcgtccgagttatgtcttaggtggtcgggcaatggaaatcgttgaaaaccaagcggatctggaagattatatgaagcatgcagtaaaagcttctcccgaacatcctgttttagtcgatcggtacttagtagggaaagaatgtgaagttgacgcaatttgtgatggcacgacggttctgattccggggatcatggaacatatcgaacgagcaggggtccactcaggtgactcgatggcagtctatccaccgcaaaacctttctgacgcaacgattgccaccatcgaagactatacgaaacggttagcattgggattgaattgtgttggaatgatgaatattcaatttgttatccacgaggaaaaagtttacgtcattgaagtcaatcctcgggccagccgaaccgttccatttttgagcaaggtcacagagattcctatggcacagatcgcgacaaaagcgattttaggagaaaaattggcggatctgggctaccgtgatggcctttatccaacaccaaacgaagttcatatcaaagcaccggtcttttctttcaccaagttacaaaaagtcgatacttacttaggtccggaaatgaaatcaaccggtgaagtcatgggttcagacaaaaacttagaaaaagctttatataaagcttttgaagcagctggtttgcatattccggaattcgggaaagttctttttaccgtagcggatgaaagcaaagcagaggccgccgtgttggctgcgcgctttttcgaaatcggcttctcgatcttagcgacaaaaggaacagccgattactttgaaggctatggcttgccagtcacccgggtagcgaaaatctcggaaacagaagatgaaactgtcgttgatctcatcagaaaaggcgtgacccaagtggtgatcaatacaatggacaaaaatcggcaaaaagccactgaagacggatttattattcgccgggaagcagtcgagcatggggtgccgctcttcacctcgttagacaccgctgatgccattcttcaagtaatggaatcaagaggtttttcaacgaaagcaatctagcagtcagaaaggaaaacagctcatgaaacaagaacgaatgaccattacaaaacagcgaatgctcgcaccgcgaatctacgagatgactctctctggtgctctcgttcaagaaatgaccacaccgggacaatttctgcatattcgagtgccggatgatgcctttctcttaagacgaccaatcagtattagctggatcgatcaagaaagccaaagttgtcgcatcatttatcggacagaaggggaggggaccaagcggtttgcccatctgcaaagcgggaatcaactggatgttttaggccctctagggaatggctttcatatcgaagatttacaaaaagatgagactgtttttatcgtaggtggtggtatcggagttccgccactctacgaactttccaaacaattagtcgcaaaaggtgtacgcacgattcattttttgggatttgctagttcggaagtcatgtattacgaaaaggcgtttcaagctctaggggatacacgaatcgcaacggatgatggcacctatggcgttcaagggaatgtcggtaatctattgttagcagccgatagcaaacctgcggctgtttttgcctgcggcaacaatgggttgttaaaaacggttgaacaacttttccaagactgtccgaatgtgcaactttcattggaatctcgcatggcttgcgggatcggtgcttgctatgcttgtgtttgtcataaagccgatgatccaacagggaccaaaagtgtcaaagtctgtgacgaaggccctgtttttcaagctggaaaggtggttatttaagtggttttagctgttgaattaccggggttgtctctcaaaaaccccataatgccggctagtggctgttttggttttggcgcagaatacaacaagtattatgatatcagtcagctcggtgccgtcatgatcaaagccacgaccccagaagcacgctttggcaatccaacaccgcgagtggctgaaacaccaagcggcatgttgaatgcgattggcttacaaaatcctggccttcgagtagtcatggaagacattttgccagagttagcgcaaaagcatccagatctgccgatcatcgcaaacgtggctggttccactcaagaagattatgtcactgtctgtcaaaaaatcagtcaagcgccgaatgtaaaagccattgaattaaatgtttcctgcccaaacgtcaaacatggtggtattacttttggtaccgatcctcaagtggtgaaagaactgacccaagcggtcaaagcagtttcgcaagtgccaatctatgtcaaactatcgccaaatgtcaccgatatcgtacccattgcaaaagcaatcgaggcggggggtgccgatggtttcacgatgatcaatacgttattgggtatgcgcattgatttgaagacacgacgtcctattttggccaaccagaccggggggctctcaggcccagccatcaagccagtcgcgattcgtttgatcaaacaagtggcacaagtttctttgttgccaatcattggcatgggcggtgtgatgacggttgatgatgtgttagaaatgtatttagctggagcgagtgcggtagcagttggtaccgcaaattttactgatccttatatttgtcccaagttgatcgaagaattgcctgtacgaatggcagaattaggtatcgactctttggcacagttgatcaaggaagtaagagaggggcattaagatgattgaacgaccaattattgctttggattttccaagcaaaaaagaaattgagctttttttagagaaatttcctaaaacagaaaaattattcgtcaaagtcggtatggaaatcttttatcaagaaggaccagaaatcgtcagctggttaaaagatttaggccatgatattttcttagacttaaaacttcacgacattcccaatactgttgagcgggccatgacacgtttggcaaatcttggggtcgcgatcaccaatgttcatgcggcgggtggtattgagatgatgatagcagcaaagcggggactgcaaaatggaaccaaggaaggccaaactgtgccgctattgattgctgtcacacagctgacttctactagcgaagaacaaatgcagcaagaacagctaatttctgtttctttagaagaaagcgtgcgtcattatgctcaatgtgcagaaaaagcaggattagctggcgtggtttgttccgcccaagaagctgctgccatcaaggtagctaccaatcctgaatttatgtgcttaaccccaggaattcgtccggctggtagtgatgccggagatcaaaaacgaatcgtcacaccagcaaaagcaagacaaattggttcttctgcgattgttgtcggtcgaccaatcacacaatctgcaacaccttttgatacttaccaggaaattaaacaagcatggaaggaagctattcaatgacagaaatcagtaaagcaattgccaaagaccttttaacgattgaagcagtatttttacgtccaaatgaaccctttacttgggcaagcggcatcaaaagcccgatttattgtgataatcgtatgacaatgagttaccctgctgtacgtaaagcgattgccagtggtttggctgcgcaaatcaaagaacactttccagacgtcgaagtaattgcgggtacagctactgctgggatccctcatgccgcttgggtagcagatattcttgatttgccaatggtctatatccgcagcaaagccaaagatcatggcaaaggaaaccaaatcgaaggacgtatcacggaaggtcagaaaatggttgtgatcgaagatttgatctctactggcggcagtgtgttagaagcttgcgaagcagccgctcgcgaaggggcaaatgttctgggggtggcagcgatctttacctatgaattgccgcagggattaaccaactttgaaaaggcccagctgccattagtgacgttgaccaactattcaacaatgatcgatactgcattagagatggactatatcggaaaagaagatattgcattgctgcagcaatggaaacagtcacctcaaacttggactggtaaataagaacaacgaatatgcctggagtgatccaagagcatattcgttttatttttatcttttttctgatacgatttgagacgattcatcaaaagttatctggcagttgaaaggcagccagtttcaatagggaggcagttttattgaaaagaaatatggatgttccatggagttattctggggagaatggtcctgagtattggcacacattgtgtgactggtatgctgaaggagcgaagtttccattgcaatcgcccattgcgctttaccatgacgatacagaggaacctgtcgatgaggatttaagcttccattaccatcgggaacgctttactgaaaaagaatttaaaaatacgattcattttgttccatataataaagaaagttacgtgacctttcaaggcatcaattactacctaacggatattcattttcatatgccttctgagcatatcatcgatgatgagcagcaagaacttgaatttcatttggtacatatgaatgaacaaggagaaaacttagtcgtcggtattttgttccggttaacagataaattaaactggatctgtaatcagcaagatgatagtatttgggatttcaaaaaccatacccaatggtttgacccatcgatgtttttaccggaaatgacccaccattttcactatgtaggttctttgacaactcctccaactaaaggtccaatcaactggtttgtatttgactgggtaggcgagatgagtcgtcgctttattctggaatttcgtgaagaagttttggaaaacaataatcgtccattgcaggatcgaaaagaccgaccaatctacttttactgatggtctagcgaacgaaaggaaggttacgaaatggatcagtttcaagagtacctaacaaaagaattgtcagaggcacagcgaaaagtcctggagccattatttgaacatatattaactgaattcccggatttgcagactcgaattgcttggaaccagccgatgtttacggatcatggaaccttcatcttggggattagcagttcgaagaaacatttctcagtctcgccagaagtgaaaacgatggccttgttcaatacccgcattgaagcaagtggctattcacaaacaaaaaacatttttcgtattttatgggatcagccggttgacgaaaagctgatcttcgacattatccgttttaatatgaaagacaaagcggattgtcaaaccttttggcgctagatagtcgttctgaaaataaattttaatggccaacaaaaaagacgatttattcgtcttttttgttggtttaaatccgggatcatcagacaatagcgaccgaattatgctaaaatagtggaaaatacacgaaaatccttttaaaaataccaactattgtgaacgaaagtacaattgaatcttttttaggaaaaagagcagagtccgttaagcttttttcttttagttgttttatagtgtgagaaaggagacttctatgcatgcatgggaagccatacagaaaacattggaccatattgaagcaaatttagctgagacaatcgaaattgatgagttagccaaagttgctgctttgtcgccgttttattatcagcgtttattcacgcgattagtcaaatcctcagtcagagagtatatcaagttacgccgtttggctgtagcagccacctatttacaaaaacagcaacggcgaatcattgatgttgcgctggaggttggattcaataatcctatttctttttcgcgatcgtttaaagaagtttatggcatttcaccctcacactatcagaaacagttgctcccattacaaaatttcgataaaccagatttatcccttagccatattgcggtagaggaaggggaaccgttgatcagtgaaggagtcgtcttagcaatacagcagaaaataatggatcagccgcgggttttcaatggtatcgttggttattatcctttcaagtatggcaaaatgctaggagaaagaaccggcgtagatccagctgaaaagatttggcaagacttttttcacgcttgtgccaatcatccatttttgcgagcagagacgctcattggtgtttcctatcctggagaggcaccagcaggtcattccagttattttgtcggggcagaatctgtcactggaagatatgagaaagacatgagccatctgacaagctggacattaccggcccgtgactatgttgtttgcagctttgagacgactaaagcacaaatgatcgtcgggatgggtaaggcaatgaggtatactcgtttttggctaaaaaaacacggtttgatagcggatggcttttttcctgagctttatcgacaatcgcaagcggagatcatgattgtcgaattatggattccttttaaaacaagagaaaattttcaaggaggaaaaacaaatgatgaattatgaagagggcctgacattactggaagaaaagtttggtaacgacaaagacaatttgatctctttagcaacgattgcgcgcaattgcggtgaaaatgggttgcctcgtcctatggtgcgggatgtagatgcttattatgagaatggtgtcttttatgtatcgacccatgaaagctccaacaaaatccagcaaatcaaagaaaatcccgaagtttctatcgcagtctgtggcgaatggtttaccgctaatggcatcggagaaaatctaggatgggtcttggacccaaaaaatgcggaattgagaaaaaaaattcgcaaggcgtttgtttggtacgatgaagttaatgatgaagcggatcaaggctgttgttttcttgccattcggttaacgaaagggacattgaatatcaatcactgggaaaagctctatcattttgattttgaaaataagcgcatgattgatcaaaatgatactttttaaccaccaacaatgcatcgattccattgatcagtcatctggactagcgttgtttcgatgaaatggcttggctgatgtgtccgagagcttcttagcgtttccaagtatttttccataaaaaatgagccgcttacggatttgttctatccacccattctcagcgattgacgagaaggctgtgtgttagagacatgtaagcgggtcatttttttaattcttcgccaacttttttggaaaatcagcaaaagaacagcgttagttttgttttaaatccaaaattgtttcctcaggtgttacataataagtcgtctggttctcataaatcacaaagcctggttttgcaccatttggtttgcgaatatgtttgacttgtaccaaatccacaggtacttgtgcggagtggcggtatttcgagaagtaggcagctaattctgcagcttccaagattgtttcttcgctaggtgaatccgaccgaatgatcacatgagacccggggatatttttcgtatggagccaataatctgttttacgtgccgtttttaaagttaactgatcattttgcagattgtttttgcctaccagaatctccgttccatcagaagagagaaaacgttccggttgcgagggcgtttgttttttccgttgtttcgtccgatttttgacatatccttgggcagcaagttcttcgcgaatcgtcaaaagatctttcggtgcggcaatttccaactgtgcttctactgattccaaataggcgatctcatcttttgtttcagcaatttgctgatgaatcagtttgacagcatttttcagcttttgataacgctggaaatatttttgcgcgttctggttgggtgtcaaggccggatctaaggcaatttttattggtttgttctcatcatagtaattagctaattccacttcgcctgcaccgcgagggacttgcgccatgaaagtcgttaaaagctcgcctttttgacggaattcttccgcattctcagattctcgcaaagtttgctgtcttttttctagcttgtgcttgtttcgcttcagctcattgtcgatttttttcagcaattcactgccttgctgttttactcggtcacggtcagctttttcatgataaaacgcatcaagcaatgcgcttagactctggtaagtttcctgccagtccgcttgttccatcagtgaatgaaaggggaccggagtaaagaattctttgttcccggattttaagtaggtaggaacaggatccgctagctcggcaaaaaattcttcccaaacggttactttttcatttggtcgttctttcagacgagataccagctcatctgccgtatccctgccaaatccttgaaaagtctgctgcaagactttgggcgacaattcttctagacgagacagcatttcaaagacttttgtttgattgagtgtatacggatcaacagtgtcttgttttggcggagcaacataaagggaccctggcagcaaggtacgatacgtattttgcgaatggccaatgtgcttgatcgtatcaacgattttaccggttgcccgattcattaagagaatcgtgctgtgtctgcccatcaattcaacgatcaaaacaaagttttgtaaatcgcctaattcgtcacgacgagtaaaatggaaatgaacgactcgatcattcgcaacttgttcaatcgtttccaggattgcgccatctaaatacttccgtaacatcatcaaaaatgttggaggtgtttctgggttggtataggtagcttgtgtacattgaatccgagcatagctcggatgggcagatagcaataatttgtgatttttcccttgagaacggatcacgaagatcacttcgttctcataaggctggtgaattttattcactcgaccattaacgagttcattttgtaattcctgaaccatcaagtgggtaaagatgccatcgaaggacatttgtttccctcatttctgttttatcaaacttttttctcattcaatttttgaggtcaagacatttgaccgataaaggcaagtaaaattaacgaatccagattgaatcgagtagttctattataacgaaaagaaaccagaaagaccaatcctgatccaagcaggacataccccatcagatttaggatatattgaagcattcactaagagtccgttttattgttttgtgcatcctttagggctttttcaatctccatattcaagaaataggaaatgactgttcgaatgactacgactactgctaagcggacgatatcggcaaatgtcggatggatgatggtctcaatgatatctgcagcaatcaagatctccaaaccaagcaaaacataactgccgagaaaatttcgaataaaattgttttctctggccgcactcatacggtctttcgcttttatttcaaaacgaataaaatcaaaaccagcttttacaactccccacacaagcactaaaattgaaagcagattcagacaaacgacgattaaatctaaaatggggattgcattatccattaaaagttcagcaagatcagccatgactaactcctttggttttttctctatcttatcgaattttacttaatatgggaagttatatgggaagtttcttgacgctccaaagacatcttgctagtataaagataagttgatggcagatgaaaagggcggggtttaggatggagcgattcgagaatttttttcagttggtaaaagtgaagatgcgagaaagctgggaagcttttgtccaaagtgtctaccaaaatcagcgtaagaccatgtattatttaggtacaggtattctacttgctgtgctatttgctgtagtgattattacttctcaaacgaggatcaaaacatcgctgatccacaagatggcttttgaagaattgccttctgataagatcgaaccattagaatatgcagaagcagatcaaacgattcgggacacaaaagccatttcggtgatgtttagtaaaccgaatggcgaagagttggcagaagtgtttcaattgtttaatgataaagagagtgaaatgaatcgatccgtgtactattatccgatcgtatatgatacacagtcttttttagatacttacggtgtaaaagcaaatgaaatcacctttgttttctttgaaaacgggcaagagaaaaatcggtttacttatcaatcacttaaagatcctgcagaagaatttattcctgaattgaatcggttaccaatgtggaatattcgcaaattagcagagtaagaaaaaatctgacaatttgaataaaagttattgacgttcttttattaatacgctaaactaagtgaaacaaagttaaacaaatggaaaaaggaggagctaatatgagactattttacgcattgcaatcaaattcatggcaaaactggcgtagatagttgtattggtggacctcaatccatagatacaactttttagagaaccttctaaagtgctgtatctatgctggtaaatgaatctttcaccgcatagaacgattagtctatgcggtttttgcttgaagcaactgccggattgtcggcagttgctttttttagttctcaagtatcaacaaaaaaatgagaaagaagcgaggagagttaaaaatgaaaaacaaaggattaattgctgcagttattgttatttttggatttttattggcggcttttgggtaccaaatgggagcaaaacaaacaggagaatccgctgaacaaccgacggatcaaacagcaaaaaaagaacacaaaacggtgggtattctgcaatttgtcagtcatgaagcgctcgacgaaatcactcgaggcgtcaaagaagggttaaaacaatcgggttataccgaaggggataatttaacaatcgaatttcaaaatggccaagcggatcaaagtaaattagcgaccatgagtcagcaattgctgaacaaaggcgctgatgtattagtagggatagcaacacctgctgctcaagcattggctaatactactaaggatgtgccaatcgttttaggcgcggtgaccgatccggttggggccaatctagtagctgatatggataaacctggaggaaatatcactggagtatcagataaaacaccagtagctactcagtttgaattagcccaagaattgatgccagaggcaaaatcagttggtatcttatattcttcaacagaggataactccaagtatcaagcagcagaagcagaagcggccgcagaaaaatatggcttgacgtcaaaaaaatatgcagttccttcaagcaatgaaattgctcagacggtacaggtgatggcagaaaccgtcgatttcatttttatcccattggataatacgattgccaatgcgatgcagacggttgtcggagaagcaaacaaaacgaaaacaccaatcatcacctctgcagaaaccatggtgcaacaaggtggcttggcgactgtgggtcaaaatcagtttagcttaggtgtccaatcaggtaaaatggcagctgcgatcttaaaaggggaatctgatccagcaacaacccccatctatacttttaaagatggcgatacggtcattaatgaaaagcaagctgaatttcttggcatcactattccagaagcactcaaagaaaaagccagactcatttctgacgaagcgaccgaaacaacatcaagcacagactaaccattgaaacagctgctcttaaaagggttatagcaatgctaactaacgtttcataaagaaacaagaaaaaaatctattgcttttaaggaatatgtgtcctgacagaaacttcttgttgtcaggacaggggtttggaagacagatagaaaaacaagtaacgaggaggaaaaaaaatgatcgtttcagcgattgggcaaggattcctttgggggattcttgggttaggtatttttatgacgtatcgaattttaaattttccagatatgactactgagggctcttttcctcttggcggcgcggtctgtgtgactgctatcacgcaaggtgtctcaccgatagtagctactcttttaggggttggtgcggggatgtgtgccggattagtaactggtctcttatatacgaaaggcaagatcccagtaattctagctggaatccttgtgatgtcgggactaaattcagtgatgctgtttgtgatgcgctcgccaaatctttctctattgaatcaaccaaaaatccaagatttcttcacgaagctaaatttgcctaattactttgatactgtgttgatcggattagtgatggtattagtgatcggggctgtcttgctattctttttccataccaatcttgggcaagcctatattgctacaggagacaacgagcatatggctaaatcactagggatcaatacagacactatgaagatcattggcttagttgtttccaatggagtgattgcattatctggggcattgatcgcccaaaatgatggttacgcagatgttagtaaaggaatcggcgtcattgtaatagggttagcatcgattatcatcggtgaagtattatttggcgaactaacattattggagcggctcgtagcgattgttgtgggcagtatcatttatcagctgttgatcctatttgtgatcagagctggctttgatactacttacttaaaaatcttttcggcgatcgtcttgacgctttgtctattgatcccgcaattcaaaaatgcactgcacttgcggacgggtttcgaaaaggaggaagaatgatgttaacgatcaataaagcaaccaaaatcattggcaatggtcctcatgaaaagaagacgctcttacagaaagtagatttaaaactgcaatcaggggaatttgtgactgtagtcggcggcaatggtgctggaaaaagtacattgtttaattgtatatccggttcactgccacttactagtggtcagatcttgatcgatgaccaagatgtcacgcagttgtcagaagaaaaaagagctgcttacttgtcaagagtctttcaagaccctaaaatgggcactgcgccgcgaatgaccgtcgctgaaaatctattgttggcgcaacgtcgtggacagaaaaggaatttgcatttgcgccaattacaagtacaaaaagatgtttattaccaattatgtcaagaagtgggcaacgggctcgaacaacatttggatacaccaacaggaaatttatctggtgggcaacgccaagcattgagtcttttgatggcaacgatccagaccccaaaattgctgctcttagacgagcatactgcggcattggatccgaaaacgtctaaacagttgatgcaaatcactgcagatcgagtggaacaacaacagttgacttgcttgatgatcactcatcgcatggaagatgctctaaaatatggcaaccgattgatcttgcttcgtaaagggcagatcgtgaaagatttatccgcagcagaaaaagcgcagcttcgtttgcaagatctattactattctttgaagacgacctttagaaaaccgaatctaccagtgaaaatcgcagaaaaaaataaatgaaaaccagtgaaatgaaaaaaataagaaaaaatcattgacaactttcaaagttcaacctatacttaggacaatcttacatcagtttggagcgaacaatcatgaaacaattgcaagagaacccctcacaactgaataaatattactttagctattttagataggtttgtattcatgaaagacatgggtacaaacactcgtttgtatctatgatggctaaggcatttcgtaatgactttaaagccacgtagatcgtaaaatctatagtggctattttttatattcacatatcagctgatatgtaatgtttgaaggtgttcactgtagattctatcaatttacagtggacatctttttttgttgaaaggaatgaataggatgaaccaattaatcactggacacacccgtttagcagcgttgtttgcgaaacctgccaaacacagtatctcgccagccatgcataatctttcttttgaagatcaaaaagtggatgctgtctatctagcttttgatgttgatccagaaagtttagcagcaagtatccaaagtattcgtcagcttgatttgttaggagtcaatttatcgatgccgcacaaaatggcagctgttcctttagtcgatgaattatctcctgccgcagaactgattggtgctatcaatacaatcgtcaaccacaaaggtcatttgatcggtcacaatacggatgggattggatttatgcgagcgctaggagacatcgaggtctcgattattggcggtaccatgacagttatcggcgctggtggagctgctacagcaattattagtcaagctgccttagatggggtagaaaccattcatgtttttaatcgaaacgatgaattttatccagtgattgaaagcaagctgcaacaaatcgcggcggctactacctgcaacatcacacttggtgatctagatgatcagcaagcattgggtctggcgatcaaagagagccaattgctagtaaatgcgactggtgttggaatgaagccgcaggaagatgccagcccattaaaagaccgcggaatgttacgagaatcgttggcagtttatgacgtgatctataatccgcgagaaacacggctgttgcgtgaagcaaaagccgcgagagcaaaaacagccaatgggttaagtatgttgctttaccaaggcgcggcggcttttgagctatggactgataaaaaaatgccgattgagaaagtcaaaacactgattgaaaaaatgtaaaaaaactaataactatgaaggtaggaagaaaaaatgatcgtaattatgaaaccaaatgccacggcagaacaagtagaagttgttgtgaaacgaatcaaaaaagaaggattagatgtacaggtcaatcaagggaaggaacaaatcgtcattggacttaaaggagatacgcgtctgatccaagatgtcgcttttcgcagctacgatggtgtagaagacgcaattcgtatttccaatacgtacaaattgacttcgcgggaatttcatccgcaggacacggtagttgatgttgatggtgtcaaaatcggagatggacatttcgtaacaatggctggcccatgttcgatcgaaggattagaacaaatccgtgaatgtgcacggatcgccaaagctggcggtgctcaaatcttacgaggaggtgctttcaaacctcggacctctccttacgctttccaaggtctggaagaagaagggctgaaatacatccgtcaagctgctgatgaaacagggatgaaagtcatcactgaagtaatggacgaaggacatatcgatatggttgcggaatacagcgatattttgcaaatcggtgctcgtaacatgcagaatttcaaactattagcggctgtcggtaaaacaggaaaacctattggattgaagcggggaatttcaggaacaattgatgaatggttgaatgctgcagaatacattgctgttcaagataaaagtgaagtgatcttcattgagcggggaattcgaacatacgaaacagcaacgcggaatacattcgaccttagtgctgtaccgatcatcaaaaagttgagtcatttcccaattatcgttgatcctagtcatgggacaggtatctgggatctagttccgccaatggctagagctggggttgctgcgggcgcagacggcatgatcgttgagatccatccagatccggcaaatgcttggtctgatggtcctcaatcattgaacgaaaaaacctacatgaatatgatgaatgaagtccatatcatggaaaaagcgatgaaagaaatcaaagcactgcaaaaataatcgtcgtttttcagctgagagtgacagctatttcagaagaaatcaagtcattgtgaagtctaaaaaaaggagtgtaccatttgatgttacacataaatttagcagaacattcgtatgatattgtcattcaacgaggtgcctttcaagaagtagggaaatgggtcaaaggactttggcaacctcaaaggattgcagtgattacggatagtaacgtttccccaatctatggacaagtcattattgatgcgcttactcatgaaggatttgcagcaaaattacttgttgttccagcgggcgaaaagagcaagtctcttgagcaagcgacgattctttatgatcgtttagcagaacttgggttgacccgaagcgatggaataattgcgctgggcggcggagtaatcggtgatttagcaggtttcgtggcttcgacctatatgcgaggggtccattttcttcagattcccacgactttattggcgcaagtagattctagtattggcggcaaaacagctgtcaatactggaaatgctaaaaatttggttggaacctttgcccaacccgctggtgttttgatcgatccagaacttttacgatcattaccactttatcgcgtacaagaaggaattgcggagatcattaagtcggcagcaatcgctgatgaccagctatggcaaaaactagccgaattgcaagatgaggcggcattattggaccatgcagaacaagtgatcaccgcggctttaacggtcaaacgaaaagttgtcgaggaagaccctttcgatcatgatagtcgcttgatgttgaatttcggccataccatcggacatgggctagaaaaaacagcagcgtttgaaatcagccatggtgcaggagtagcaatcggcatggtgatggtcacccaacacgcggagtccatcggattatctccaaaaggaactacggcccaattaatagaaatgatcagcaagtttcatttgcctactcagtcagaatcgcttgacaaagatcagttgtatcaagcgatcactcatgataaaaagacccgaggaaaccaattgaagattattttgttagaaaaaatcggtcaagcgaagatcgttacgatccctacagaagaaattaaaaattatttataaaaaagagaggaagcgacggatgatgcgttatattacagcaggtgaatcccacggacctgaattgaccgcaattattgaaggtctaccagcgggattacccttaacagcagcagatatcaatcacgaactagcgagaagacaaacgggttatggccgcggcggtcgcatgctgattgaaaaagatcaagtccgtattacttccggcatccgacatggaaaaacattagggtcgcctgtgacattggtggtggaaaataaagactggaaaaattggacgaaagtgatggcaatcgaggaagttcctgaaaaagatcggaaattacgacgagtggctcggcctagaccaggacatgcagacttggtcggaggcatgaaataccgtcatcaggatttgcgaaacgtcttagagcgttcctctgcgcgggaaacaacgatgcgagtggccattggtgcaattgccaaaaaaatcttaaaggaattagagattgaagtggctggccatgtgacaatgcttggcggcataaaagcagctattcctgatggtttgactgttcaagaaattgccgagcgctccgaagcatctgaagttcgggtgttggatccttctgtcgaagaagaaatcaagcaattgatcgaccaaaccaagagaaatggggatacgattggtggcgtcgtagaagttctaatcgggggtgtccccgctggtctaggcagttatgtgcagtgggataaaaaattggatgccaaaattgcgcaggccgtggttagtatcaatgcatttaaaggtgttgaatttggtgtcggatttgaagcaggagtcttacccggttcgcaagtgatggatgaaatcctctgggatcagcaaaaaggatacacgcgtcgcagcaataatttgggcggatttgaaggaggaatgacaaatggagaaccgattgttgttcgtggagtgatgaagcccattccaacgttatacaaaccgttgcaaagcgttgatatcgatagcaaagagccctacaaagcaagtgttgaacgttcagatagtacggcagttcctgcagccagtgtggtttgtgaaaatgtcgttgctacagtagtagccaatgaaatactcgaaaaatttccgagtgactcctttgaagaattacaaacagctgtccaagaataccgtgactacttgcttcattactaaaattcattactaaaagtagtagagtttatcccactactaaaaaatatcttgagaaaaaggaaacgagggacattccaatgtcacaaaaaatcatgatcgctggtctaggattgatcggtgcttcgttggcaaaatgcatcaaaaaagctgttgctgacagctatctgattggctgggatcattgtgaatcgaccaatgaaattgccatacagtcacagattgttgacttcgtgccagcttcatttactgaaggagcgatccaatcagatatcatcattttggcacttccagtggagatcacgaaagcttatttggctgaattgggaagagtaactttaaagtcaaatgtcttagtaacggatactggtagtacaaaagcagagattgttcaatttgcgcagcaattctcctttgattttattggcggtcatcctatggctggctctcataaatcgggtattttagcagcagatgagaatttattcgaaaatgcctactacattttcaccccgactactagcaaccgcatgaatgaactgcagcgattgtttcaagggaccagagcaaaatacgtcgaattggcaccaaacgagcatgatcaaatcactggaatgctaagtcatttacctcatattattgcttccgggttagtcaatcaggcgaatacgtttaatcaatcacagcctagggctcagcaactagccgcaggagggtttcgggacatcactcgcattgcttcttccgatccccgcatgtggacggatattttattaagtaatcgacaggagcttttgcagctaatcgcaacctggcaaaaacaaatggagcaagtatcacagtggttgctgaccaaagatgaaaaagcaatattccgtttttttgaagatgctaaagaaacaagagaccatttacctatccaccaaactggagcaattccagcgttctatgatctattgatcgatgttccggatcatccgggtgtggtagcagaggtcacccagctgttaagcacgggcaatctctcattgatcaatttaaaaattttagagacgcgtgaagatatacttggtgtcttgcagatttctttcaaaagtcaaaaagagctgcagcaagcccagcagctgatcactgaaaatacgacctatcaatgtcggataaaataggagaacaatgatgaaactacttaaagctaaccacctaagaggcacactgacagtcccttcagataaatctatttctcaccgcagcatcatgtttggtgcattagcagaagggacgacgacggttcgtaattttttaagaggggaagattgtcttagtacccttcacgcttttcaagaattgggagtccccattcaagatgacggcgagacgatcacgatcactggtcaagggtttggcggtttgaaagctgctgaccgttcgattgatgtaggaaattcaggcacaacgattcgtttaatgatgggtattttagccgggcaacctttcacgactactttactgggggatgattcgttgaatcagcgaccaatgaatcgagtgatgttgccattgaatcaaatgggtgcgagacttaacggcagcaatgaaagtgagtttccaccgattactattcaaggtacacgcgatttaagcccaatcgattattcaatgcctgttgctagtgcacaggtcaaatcagcgttactttttgccgcattgcaagcacagggtacctcccgaatcgtcgagaaagaaccgagccgcaaccatacggaagaaatgattcgtcaatttggcggcgagatcacggttaaaggaaaggagattcaaattacaggtcctcaatcctttgttggacaagaagtgattgtaccaggtgatatttcttcagctgcttttttcttaaccgcaggagctgttttacccaatagtgaaatcacgctagaaaatgttgggattaatccgacgcgaacaggaattttagatgtgctggaacaaatgggtgctcagatttcactgacagcgatcgatcagaacaatcaatcagctacgattactattcgttcttctgcattaaaaggaatcgagatccaaggcgcgatcattcctcgactcattgatgaattaccaatcatcgctttgttagctacacaagctgtcggccaaacggtgattcgtgatgctgaagaattgaaagtcaaagagacgaaccgaatcgatgcgaccgcagaagaattaacgaaactgggagcagatatcacgccaacggaagatggattgattattaatggtccgacgccccttcatggtggtaacgtgtccagtcgcggcgatcatcgaattggtatgatgctgcaagtagctgctttattgacgcaagaagatgtggaattagaacaggcggaagcagtagcggtctcctacccccacttctttgaggatctccgccaattaactggaggtgatgttgaatgaaaggaatcgttttgatcggttttatgggtgctggtaaaacaactattggccgcttattagcagaacgattacagttggcacatgttgattttgacgatctgatcgttgaatcgatcggcatgacgatccaagactattttgatcgttacggggaagccgcttttcgagaaaaagaaacggagattttgactcattcattaacacttgatcaagtgatctctactggtggcggcatcatcctaaaagaagaaaatcggcaactattgcagcaatttccgaaagtcgtctatttaaaaacggagccagaagaattgctcgatcggttgaaaaaggatacggtcaatattcgtccgcttgtcgtttcgaaatcgccggcagaaatcattgatatttatcgtccaagaatgccactatacgaagaaagtgcgacagtagtgatcgataccacccgcaaatctccagcagagatcgtgactgaaatcattcaaaaagcaggtgaataaatgaagattggttatctaggcccaaaaaactccttcacttatcgagccgcctgtgaatcttttttaaatgaagaaatggttccttttggatcgatcccattatgtattcaagcattagtagcaggggacatccaacgagcggtagtccccaatgaaaattcattagagggttcggttcatgcaacaatcgatacacttttccgacaaaaggaactgatcattgaacaagaagtgattttgcctatcaaccatcagctactgaccattcagtcaggacagccgatttccaaaatcatttctcatccacaggctttggcccaatgtgcggagtttttgcaacataacttcccagatgttcctattgaagcggtggcatcgacgactgctgctgccgtctttgtcgcagagcatccagcggagccggtagcagccattgcttccaaagaagcagcccatgcttatggtctattcattcaggaaaaaaatatccaggatacgactagcaaccaaactcgtttttggatcttgcaaaaagacacaaacgaatcgagcgttttccatgataaggcaacgaaagccacgatctatgtgaccttgcctaccaatcgaccaggtagtctgcatcagattttggccgcttttggctggcgcggcattgacttgagcaaaatcgaatcccgaccattaaaaacgagtctaggggaatatttttttgtgatagatttagtgctaaatcagccttgggccttggttgagaatgccttagaagaaatcaggatgttaaattgtaatgtccatcttctaggttcgtatgctgtgaagaaaataggtgaaggaaatgaaagagaggaaaatcagtccttgcgaggatgctgatttattagctaaactttatcaaagtgttcaagaggtccatcatcaattgatacctaacgttttcaaatcctttgactacgaggcattccgcgacttgttacaggatttgcttgccgcagaaacgcatcatttttttgtagcctggcaaaaacaaccttgcggatttattcatctaaaagagattgagttatcggatacaccgctgatggtctctcaacgtcgacttgagatcgaagcgttatcggttgaaaatgcgtaccagaagcaaggggtcggtgaagccttattaacccatgccgcagattttgctcgagaaaagcagtttgcaaccctcactttgaatttctgggccaaaaaccaagtggctgatttttaccaacgaaatggttttcaagttgaacgttacagagcaagcaagattttatgagccgcttttcatctttctatcaaaaagttgctaggaaaatcttaaaatttaaaaaaatagctttctttctttttttcgtaaggtattcttataagaaagaaaagctttttttatttggaggaaactgtcctatgagtcgaatggaccgcaacaaaaaattgcatgaacaattagcgaaagaagagcaacgagctgctcataaagaaacgatctttgctcgtcgagaaacaaaatctgtgagaagacctcaaaaggaagaagagtattcagcagaaaacgattttgcacaacaaagggagaacgaccaaacaagtcagaagcggtcttctggcaatcattcgtcaaaaaaaacaacccttcagcggccgaatctgttaactggcaaaaaaaacaagtcaaaatcctttggtaaacaaaaggatttcggcaacaatggtcagtcagttaacaagaagccagcgaaacaagagcagaaagtaaaatcaaaagaagctaaacgtaagaaacggccaattttgcgtttcatcctgtatgtgctagtgtttgtacttgcttactcgatcgtggcttttgtggcagggcagcaggtggccaaaagcgatgcacaagtctcagagacggaaacgtttgatggtgtagcatctgcgaacggagcaaaaaatattttgcttttaggaagcgacagccgtaaaggcgaaactggtcgtgcagacacgatcatggtgctgcaattggatggcccttcaaagaaaccaaagctgctttctttcatgcgggatacgctagtcacgattccgggatatggagaaaacaagatcaatgcagcttatgcatttggcggggcagagttagttcggcaaacgttagctgaaaatttcggaatccaaacgaattattatgtcaaagtagactttcaatctttcgaaaaagtgattgacaccctttttcctagtggtgtaccgatcaacgctgagaaagatatgagtaaaaaccttgaagtccctatcaagaaagggcaacagaatatgaacggtttagaattattgcaatatgcgcggttccgtatggatgaagaaggcgactttgggcgtgtgcgtcgacaacaacaagtgatggatgctgtgtttaatgccatgaagaatcctttatccatcgttaaattgccatacgcagcagggaaagtcctagggtatgcttctactaatctgccagttagcttcttgctgagaaacacattttcgattgccaaaggcgcagggggcattgatcgcttaactgttcctgtcgatgattcatggcagtatggctcaacctatgaagcaggaagtgtgctggtcatcaactttgataccaataaacaagccatcgaaagtttcttaaatcagtaagtttaactgaaaactttttgaaaagagttttgaaagcttactggtttatgctatattattaatgacgtttgaaatatgttgaaacgaggaaaagaaatgaaattagccgttgttactgacagtacagcttacttgcctgaacgcatccaggatcacgctgacttgttcgttatcccaatacctgttattttagatggaaaaagctataacgaagggatcgacattcagccagatgaatattactctttgctgaaaaacagtaaagaatttcctaaaacttctcaacctgtccttggtgaagtgattgcattatacgaaacccttgcccagaaaggttatgatacgatcttaagtattcacctttctagcgggatttctggctttatcaatacgttatatggtatcaaagatgatatcaaaggcgcgcgggttattccctatgattctaaaatcaccagcatgccaatgggacatatggtagaagctgcgttggatctgaaccaacaaggcaaaaccattgaagagatcgtgacccacatcgatcgcatccgcgataatacgtatgcttatttgatcgtagatgacttaaacaatctcgtgcgaggcggacgtttaacaaatggtgctgcattgatcggcggattattgaagatcaaaccgatcttgacttttgacgaaggaaaaatcgtgctttatgagaagattcgttccagtaaaaaagcttttaatcgcgcagaagacattattggtcaaagagaatcagaaatcgcttacccagtgaaattctatgtgatccatgccaataacttgtctgtggctttagaggaaaaagcaaagctgcaaaagaaataccctgatgccgaaatcgaagtgggtcattttggtcctgtgattggttctcatttgggtgaaaaagcgattgggattgccatcgcagcgcaataataaaagtgagttatttattcctatgcaattatttgatttttataaaaatacctatgttacttagaagcttgtcaagggattccttttgctagtttctggtcacatgggtatttttttgctttaaaagcatcttgcttgtttatctgattcacactgactatacttaatccaattactactttagtaaattactaaacaggaggatggaaaatgaaaataccagaaaacttaaaacacaaacccgtcatcaaagttgaagactatgatacagtagatggacgctatgcgcttcatacggatgcgaaaggcttatcgttgggtctggcacaatggaatgatcgaggaaaagtagatatctcagggaaagtatggcggcacacgggggaaaagtggtctcgtcaatcagaagaactcccattatcacggattcttgacttagcgatccttgtcgcgcaatctagcctctattttcaagatgcctatcgtcatgaaaagttttatgatccagaaaacccactcatcgatattattggactgcaaggaaatcggatgacagtagaagttgatacagacaatcctaaaattgatgaggatattctattgttctatgatgccttgcaaaaagatggtgaattgatcggtgaacgttttcgaattttaagtcggttgttaaacgaattgggctattaagaaaggaggaatctacatggggatcaatcgtaccccttttactttgacagaaggtcgacagttcagcaagttagaacagcaaatgatttggaaaaaaccagcgagtcatcagacaagtcaagaagaactgcggatcgctcaagaaatcaagctaaactggcaagatccagagatgaagattttcaatgttttattggaaggagatgctggctctggaaaaacgcaattagccaaagctctctcctatgatcttcaattgccttataccaaaatcacctgttttgctgatatggataaatcagatgtttttggtgcattgttgccgatcgtagcaacagatcaagaagaagacagtgaattgttagaagcgatctatttgagtaatagcttagatcaggtcattcaagtgattgcggatcactattcgctcaccagtgagggtgcccgagaaaaattagcagacttgattcgacgacttgaagaaatagatacgaccgatgtcgttcattataaattttatccttcggaaatcgttcgtgcgatggaaaaagggtatctattagaaatccaagaaccaacagtcatccgggatgcctcggtactcgtcgctctcaactctgcattggagcaaaatgggatgctgaatctgccaactggcgttgtcaggcgccatccggattgtgtcgtcattatcacaacaaatcggaactatcagggcaatcgtccattgaatgaatctcttagagatcggatgcaacatgcggaaaaaatggaccttcctgaactatctgtgatggtcgcacggggacttgctaaaaccggctttcaagatcaagcgatcgctagcaaaatggcagagattattcgacttctcgatacttctgcacgagcaaatgccatcaagggtgtggctggtatgcgatcttatttttattggctgaatacggttaaaaatgggcaatcacctttaaatacgttagcggtcaaagtcttatacaagttaacgacagatccagacgaattgcgtctgctgcaagaagccctcgatcaatcagaattgctcttagagctaagacgtttgtatcaaggacagaaaatgagtcatcgacaaccaatacatggacgcatcgtatctgctgaagaggcggatgcgcgaaatattgaagaagcatccttgcagatggggacagcagctagtactgaaaaaacagcagagacactggagacacctgaggtgctagatacacaggaaacaaaccaagataatcaggaagcggtgcctcaagacactatagatggagactctttagagagccaacattcgtctgatgagggacacacaaaggaaggaagtgaacaatctgctcaagaaccttccagtcagcatctttcgatcgaagaattcaggcaattggataaagaagtaagaaaacaagcaaatcaagaagcgcggcaagcgctaaaacaatctatccatgcgaaagaaggattgattgtgcatcggccaaaactccaagaaaatgctcctcagaaagcccaacaacttctagcaccgttgttgccggtggttgaaacaataacaaaacagttgcttgaattattagaaaatgaagcagcttcttcttatggcaaaggaaaatatagcgggacacgctttgatgcaagtcgtgttgcttatggcgactttcgaacatttgataagaaaaatcctcctcatgaacagccttcattagcgatcgctttacgaatcgatgaatcagggtccatggtacgggagggacggatcaccgctgcacaacaagctgcactcgcagtgagtgtgtttgcacagcgcctagatctcccgctgatgatttatggcgacacagccgatttgtctgtacgagagaagacttctctctattcttataaggaatttgctgaaccttttgattatgtgccggcaaagctgatgtctcttcaaccccgacaaaacaatcgtgatggggcagtgctgcgggtactagctgaaaaactttcccaacaatctgctacgacaaaattactattgacgattagtgatggtcagccaaaggcaatgccagattatacgggcaataaggcgaaagcggatattcaagcagtcatcaaagagtatgaacgccaggaaatcatctttttgtccgctgccatcggacaagacaaagacgtcatcaaagaaatctatggcgcggaaagatatatcgatatcagcaatcttaaagaatttcccaaacaattattaacactgatcagccgttatttctaaattacgattcattcggctgctttttaaataacatccgtcttgcatagaagtgggaggcggatgttatttgtttcttataaaaagaatatgtaagctaaattaaacgaacgttttcaatttctgcttcgtatgctaaactgatcacaaaggaggaacaacaatgactttgaattggcgttatatctatcctttctctactgcaggagcttatttcattcgaagaagaacatttgaagaagaacattgcggatgagttatggactatttacatttgtgagttcgttcttatttttttgtgaaaagtggacattcttttttttcgttggtatgctcttgaacggcgtttaaaacagacttcacaagacagttcttttcaaagttggctctttttactccttattttcttaggggtggtcggtattctatggatcggcatggcagttatctttttcctatatagtcgttcatgtgacaaacaattccttttttccgaaggggaaaaatccgtgacgatccgatttttagtaggacaatcgcttcatttgatggctatcgaggagactcttttttccttgaacgggattggtttggctttttagattggcgattcattaggcgggattgtttttgaacgagcctttcatgattttagccagtttttatcagttgcctgctggattactgaatagcggttcttcagtgatatcttgggcatggcatttactaattggtctgctaggggtcctaggctgttggcttggctacaggagccggttgtctgaaatcgtcaatcgccatgaagtaagttgatgtgaaaggataatgttctatcgatgagaaaaaaatgaacgagtctcgtttgcacttgcttgctaagatgatgacggctaccaacgtaaatcgtttcacttagaaaaccttgcaagcgggatctctagttaataatctttgtttttaaagagaaggggtgtttttttgtttttagagatcaatgctatttccaaaagctttgacaagaaacaaatttttgatcaggtaagttatcaatttgaaaccggaaaaatctatggtattttagggcgcaatggggcagggaaaacgacgttattccaatgtatcgctcggaatatgaccgttgatagcgggagtatttatttagttgaagacggcaatcaacgaacctatgaaaatacagatgtcggatttacattcacgcaaccgcatctgccaggttttatgacggcgattgagtttttgcgcttttttatggatgtcaatcgggagcgcatcaaacagtcgctttctccagaagaatttttaatgtctgtaggaatttcttcagaagagcagcatcgtttaatgaaagattattcccatggcatgaaaaacaaagtacaaatgcttctttctttgatggtgcagccaccaatcatgttgtttgatgaaccattgacctctttcgatgttgtagctgcccatgaaatcaaacaaatgatccgatcagcaaaagaggattcgatcatactgttttccactcatattttacagcttgcacaagatttatgtgatgaagtggtcctactaaataatcatcaattgaccgggattgatccttctcacattcatgaaccagattttgagaaagaaatcgttactttgctgacggagggggagcccgatgctgcaatggattaaactttattggctttatgaagagacgattttttcaacgaaagcgaatggatttctctattttttgaccaaaattcctttgattggaaaacatcttccccatgatctttatgggcaatacggtctcaaaaaaatgctttttactgtattatttagcttgcgcttgatcttgccatttttcacaaaaattatttggctgcttttttattatgcaattgccttggttgcttttcatggttgggagaatttatttggctcttttgatcagtttgaagaacaaataatgattgctggtttttatacttggctagtggtcgttgcactagccagcaattttttttctttgttctcatttacattagatcaaaaagcgattgaattcacggattacttcatggtgtcaaaacgacagtatttgcgaatgaatcttttctttaagacgatccaatccattatttattatctaccagcatttttgttgtacagcttttttgctggcaatagttggctgaccctcgttggtatctttggtgctggctttgcttgtgtggcagctgccagtctaattcgctggggattccaaaagcaatggggcagtggctggcgcatcggttggcgactagccatatctatgctgattttagcgtcgctctacggcttattgcttcaacagattattccaactatgacattcgggttgggacttttggcgttctttctgattgccggcactggctgtttttactacctaaaacactttacacaagaaaatgattttttcctttattctgttgaaaaaagctatcagcaatttagtgtgctagaaaccatcagttcagattcaagtcaatatctcaatgaagggattgaaatgcagaaaaaactttctttggatcaggagaagccactcactcatttgcaaggatcagaatacctcaacggattgctctttcaaagatatcgtaaactgttgcgcaaaaaattgctgaaccgtgtcggtattgtgtctattctatttctaggattgattttattatcctttttgaagattgttccatatcctaatgaagaggatctgacagcactactgccagctctatttttagttatgtattttggttcattgggaaaagcaatcgtccaaatggtttttgttaactgtgacatctccatgctttactatcctttttatcgggagaaagaaacgatcctcagtgggtttaattaccgttttatcaaatcaatgttttacaacggagtctttgcgggaagtatttttgtcggcttcttattatgggacttgctaaatggattgcaagctagctggtatttcattggggtcttatttttattattgacgagtttgacagcattgttctcatttcatgaattatttatctattacttgctacaaccttttactggagatatgagagtggtcaatccggtctacaaatttgtcagtggagtattgtattggatcagctatatcaacctgcgcctgcatgtttctggatttgcttactcgatcgttgtctcaatggtcttattactctatgtttttgtcggatatgtactaatcattcgcttcgcgccgaagacctttaaaatcaaagaataggagagaatcaggactgcattataaaacctattcacaaatgcgaacatatgttttataatgagagaaagttgtgaataggagggtctagtcagatgaaaactacgttgactcttgaaatggaagaagccctttattattactgtcgcgaaaacagtgatattgtcatcgaagaggtaatcatgccggacgatcaaggaatcgttgatactctaagttgtcgcttaacaccagaaaatttgtttgaatggcgctgttatgaattaaaagtcagcctagcggattttcgttcaaaagcgaagctgtcatttattgggcattataattattttgttttgccgcatgcattatatgtaaaggtcaaggaagagattcctgctgccatcggtgtattggtttaccatgcatttgctgatcaagaaaaggggagccctggttattttagcgtcgagaaaaaaccgcagcggcaatctttactcgtcaacgaaaacgcattgttgtatcgtttgatctctgcacaagcacgagaagtggggaaggccaagcaaacagcacgaggtttgcgcgttttctcgacggaacgattgtacaaagaactaaagaaaagggaaccagaatacgatttatttggcggcggggtcaattactacgaccgttttattgaagatacgcagctacaagctattgaagcgctaaaagaagaactggttgcaacgcgagaagcttatttcgaattggaacagcgttttttgacacaagaaaaggagtagcactatgtattatccatattttcgcggcaaacaatttgacttgttggcattaaaaagtctattagaaatggaacagctgtctttagaagttcaacccgtcattgagcctatccggcaatccaagactttttgggatacagttgagctgtttcagaaaaaagcgcatcctttttttgttatcgtcaatccacaggcgggggactttctgacggaagaaggaagtcgtttattacaaacactgcctaacgctaaagcctatatcatcgatcagccaattgaaaccattgactgtcagccggacctttgggttgttcatggatctgctccagcgttggccagtgactggagtaaaaatcagacaccgatcttagttggacaagaattccgtttattgaaaaaaatccagggaccaaagattctcatgcatgatttttttactagactgcctagaaacagcttctatcaggaagtaccagaagaagtgttaccaaccgtttatcagcactacgagcagcaaggattttccggctatagtgatttttctatcgacagcaaaatctattatgcacatagttatccctctaaaacaattgttttacactggctatttattgatcagcagcagaagttgcgaatcactcattttgtttcggacgaatcattagaaactcaaaaagaaaagtttctacagctcatgtcacaagttttgcaacatgaagaaatctatccaactcaaacatcaggcttagagttattacttgaagcatacaaaaaggataagtttccaggtatgggtgttttgcggaaagctgctgtcatgaaccacttggaattaatcagccgttatcattttacatgattgttagttatgtcatcagtcatataaagaaaagtttctctcaggagctgaaatctaactgcagctacaatcatagattttggttgcagttcaatcatcactgaaatcaccaatcagtcatgcatcaaaaatcctaataagcagctgaagcacgctaaaatttgttttaggaagccaactgtacaatactggcattcaatacataaaaatcatcaatctgcgcggcaaagactcattttttactcaaaatggttcactttaagaaaaatcgctgtttttaaggaaaaatacagctcaatcagagggaggagaagtaaattcaccagattttttcagaactttaaaaattatttattttagtttacataatatatattatacaaagttatatttggaaaaagacggttcaaaatgtttttgatttttgcattttgaccctctctcgctgtctttttccccttatgaatgttgaaatcaacaacgattcgccaattttcctgtcattggtgtttatttggctgctaattgatgtattgtcttggtgtatgtcactgatcactagtttaatacatcgatttcatttgattgggtctcgtcattaagatctttcgtttgttactaagtgactcatttgtttgatttcataaaattgttgctattgctgtatatgtttcgtttataagtttatcaggtatcagattaagctgagttaatttccttaaaatcaattcttgagtttacttcaaaaaatagcgatcgatagttataaaatgcatttctgtggttgtgtctggcggctgcgacgatcatttctgtttgagttttcttaattcatctgggtgaaagccaaaccacgggttcaaaccagttgaggcattagggattaaaactggtacggactggaatccgtatagtttcacttcttcgcgaaattcttctttttcttcaatgttcttttcgatatatgggattcgatgagcgtctaaaaataattttgtctttttgcattgaatacaattagttttgcaataaagcgttatcatataatattatttctccatcctttttatttttattggtttttatgttatttttattgtaaatttaattcttgtttaattcaataatctttactcatcaacatataaataaattggtttactactgacctgatgtgagttgagggaaaaagattttgctgataaaagtcattaaaaaagtgtatctatccatccctgtcctgtttgagtttaagatcgccctcactcctatctatttttgcggcaaaatttaaagaactgttcgctttacaaatgcgaacgaatgtttgtattatagtggtgagaggtgattcttatgggcatgctccaaccctacgaagatcgaaaaaaattaaaatggcagggattctttctatcggaacatacaacagaagtcggacaggatgagcgccagcgtcactttgtgtggcctgcaaagccagccatgactagcgaagagatcaatgaagtgttgactttagctaggatcaaaagtcgagcagtagcgatccaatgtgaagaagtcaatgaagacggtctctaccctcctgacgtggtcggcatgatccaaagctacgattctttaggcatttatattgatggacgtaaagtacattacgatgagatccggcatatttcctttttcgaagagacgaaatggttcgcactggatgaatgaatcgtaggcgatgagccacgacaagcgtacaatcggaaagttttttacggaatgtgcaaatctatttttttaaaggaggtttcccctatgcaaacgattaaaggaacagtgacaaagattcgattgctgacgtttacttcttctcccctcgtccgttttacagtaggaacgacgaattgtttgatcaatcgccatagcttatcttttttagcagatgtcacggaaggcatgtctttggtggctgttggcgagtggaatgcgcgcaagcaatttattgtccgtaaatatgctgttcgggggaaaacgaaaattatgatggacatcgaacaattgtctcaacaacgaggaaaggcggttctttcatgagagcgcgggatttgctgacagcattaacgacaacgacacaacaagagtatcagggaatttacttaagccgtaaggaaaccttggtccctttcacgacgattgcacaagatgcttctgggaacttgattttattttttgaacctaatcgtcccccactatccatcaaagaactttatacgagtttaatgttgcacaaaaacttacctttgctctattgggacggtgaagaacgacaaaaggtctatgggtttcgtgaagaagatcgacagatcattctctgatcttttttctgtgagataccaaccaatcattcttcttttcattcatggtatactatagatcaagaaaacattttcaacggaggtaaaaaatgggaaatccgcgcatatacaccatgtcttttgcaagtgtctatcccctctatgtacagaaggcggagcgcaaaaatcgtacccaagatgaagtggatcagattattttttggttaactggttattcgaaagaaggtctgtcccgacaattagcagaagaagtttcaatggaacgtttcttcgcagaggcgcctgacttgaatccgaaaagaaaaatgatcaaaggagttatctgtggcgttcgtgtagaagagatcaaggaacctttaatgcaagaaattcgatacttggataaattgattgatgaattagccagaggaaaaacaattgaaaaaattttgcgaggatagtttttaagtggtcctattctataattattgcgtttcattggtccattacgtataatgagactaccttggcaggggcaaatcgtttgcttcgatccgttgggcattcctgtccgacggatttttttatttaacttcagtctaaaaaaagcgctgtggctcttttgcaggaatcccattttggtacctccctttcttaatgtgattaggaaaacgagtcaaaatgtatacagcattcaggtcacagcgcttttagtattgctatctttctctttttttacgtgcttgcaggtgttctttgtgtctcaaatagaccaattctttctccattttacggtaacggttaaatagatcttgcgagagttctccagaagctaacgcttctttgactgcacaatttggctctgattcatgacgacaatttttgaagcggcatttttctgctaaaagttcaatcatctggtaatgccgatctaatgaagaagcagcaaccgtctccaaactgatttctctcatgccaggagtatcgatgaccattgccccatttggcaagcggaacagctgtctactcgtggtagtgtgacgaccacgcccatcttcttcacgaatggctttggttgtctgccgttcgtctcctagtaattgattgagtaaagaagatttaccaacccctgaagaaccaataaaggctaccatgctttctggcgtcaaaaatggttcgaattgcgtccgctcatctttgtagatggtggtagctaaaaccggcaaagcgaatgtcagcttcagctggttgatgattgcttctgtttctgttgtgtccatctgatcgatttttgttaatacaatgactggattggctccactgttccaaacaatcgtaacgaaccgctccaagcgagcgagattaaactcttcattggcgtttgttgtaagaaagacagtcgtcacattagcagcgattccttgttcgtctggtcgatttccagctactttccgctgtaaaaaactttttcgcggcaagacggtatcaatcaaaaattgattttgatcataacaatgccccattacccgatcgcctacgatcggatagtctttcaatgctgttgcttgctggcgaaactttccggagacacgggcataacgttcttctcctgaagacaagactacatttgccagatctttcgcttgaaagataacaattccttgattttccatgaatttcctccatttatgtttggaggtgccactctataaagggaaacctccatgatcttgacgtccattataagtattcatatgacatttcccctttcgtgagtaaattcatcgattgatgtatccctagtatagcatttcttgcgattgtcagaccagcttttcttttatagctcaataatgattagccgcaagaaatgctatggagcgttgaatatcccctgtcaatggcttcaaaaccactaaaacgaaaaagctgaaactcacgcgatagacagtcctctttaaactctcttcatcctctacgattttttcaagatagctcctcgctcattaagcaataagcctccccttgtatcactgttctactattatcgttgttccttcctatcttcttctgagatccccattcttgccctatcttccctatgttcattaacttttgaccattctcctttacccattagtgaataatcttagttcttttgtaaatgattcgttatataatattctcttttctatttattcatataagaaatatttggtaaaaaaagtttttttcttttcaactgttatttaaaaaatggtatgatagcagcagaatatttattttttcctcctttattgaaactcgcaaccccatcttacgctcgcgattttacaaaggagcaaaccatatgttaggagaaaatcatggcaaagaaacttcttggtacaatcagtggtcttttgattgctgctgtacttggtatcagcttgtacacgcaaacccaaaaagacccgaaccccacttcatcacctggacactcatctactatacaggtgaaacagtcagagtcttctaaagcatcagattcgcatacaaaagaaacccagtcagcaaataatctcgctgcattgacatatcaagggacacaaaccattactatcaacaacaatgtcccctccttctcacaagataccctctctataaaaaatggtgcatgggaaaaatatggtgatctcgatcgcttaaatcgagccacttctgcggaagctatgttgaatcaatccctgatgcctactgaaaaacgcggggatatctctagtgtcgcgcctacaggctggcacaataaaaagctgaaaaaaggttatctttataatcgaactcatttgatcggctttgctctggcgggagaaaatgccaactggaaaaatctgatcacaggtacacaacagttgaataatcccgaaatgttacgctatgaaatggatatcaaatactatttagaacaagatcccagccattatgttcgttattcggtgactcctatttaccgcggtgatgaattagtggcacgaggcgttcaaatgcaagcccaatcgattggcgataatacgatccgcttcaatatttatatattcaatattcaagatggtgtgacgatccattaccaagatgggacaagtgtgctttctgaagaagcatctgatgcgactagcacttcggcaaaaaatactacatcgaatgttgctgaagatgaaaaagaatatgtagacgcgaagggaaatggtctgataaaagggtcaaaaaatggcatttatcatctgccaggtacgagaggctatgaacagacgacaaatccaaaagaatggttcaaaacgattgcggaagccaaagctgctggttatcgagcaccaaaataaaaaagcctatggcttttttattttgagagcatccctattcgacacgttaaccttatagcgcttgctcgcaccttgatttttgtaactctgtcaaatagttatttcctgcttctgttaaacgcaatgtgcgtgattttggaaatttttctctcgtgattaggcctctattttccatccgaagtagatgacggtgaatgagagaagttgatttgattccttcatgggcacaaatttctcgaatagatggtgctcgtttctgttcttgctgataagcatcaataaaaaataagatccgatctcttctaatcatattttcctccagggggtagaagacaaaagcaacggacaattgaaaaacctaagcgtttatttcctataggtaatattataaatgaaaaattcccttggaacaacagtttttgaagaagtcgctggcttttcatcgcatttgttttcttttgactttatgatgaaaagagtagaagaaaaaagtgaggcgttggtatgagttttggcgaaaatctaaaaaaattccgagaagaaaaacagctcggcgtcaatcagttggctttgaaatctggagtcagtgcagcgcaaatttcccgctttgaaaatggtaagcgtaagacaccccatgtggatactgcaaaaaaattggcaaaagcactctcagtcccattgcctttattgattggtgaatccgtttcatatgatgaatgggattatgacgaaaatcaacggcgagtggcccatcaaatcaaagatatgaccgaggaagaaatcacggatatcttagaatatatcgcttttgttaagcaaaaaaatagaaaacgctaattgaaaaaagccatctgtctctaaaaaaatagaatcagatggcttttggcctgctctctgacgagaattaccagaaatgaaattatcgtggataaactgcttggatactgtcttcaagaatcttcatttgtactagggtttcttcgtctttgactgttttaggctttccattaataatagcttcatacagtccggcataaacacggctatagtctcctacttcagaaactactttttcctcatgatagattccttcatcatcataatacgtcagacagccataatgttcaggaagatcaattccaaagtccgcatgatcaggcatataaaacatttttaaatgctcttcttggcgatctttggtttgtttgacaaacatgcctttcttaccataaacgacaaagcttggtcgttctttgattcggaaatagcttgatttgatcgatacctttaaagggccatagaagaagtccagatcgaaataatcgttcatgcgattcggacctaaaagttggcgaacttctgaatggtatgtctctggttcgccgaaataagacagcacttgatcgatggtatgacaagcatgtccataaagataactactatttaatgagaattcttgtgtattttctggaatttcggggcgataatagtcatagtgcatttctacttcaagtaaatcccctagaacgccactttcaataactttttggacagtcagaaagtcagaatcgtagcggcgattttgataacattgaatcaacagtcctttttctgcagccaaagcaaaaagttcttgagcttgtgcatatgtttcagtaaaaggtttctctagcaatacattctttccgtgaagcaatgcatccttggcagtttcaaaatgcagatggttaggagtagtcacaacgactaattgaatcgctggatcatcatagatatcgttgatatctgttgtgtaggtcgttccaggaagttttgcccaagtatcgcgaatcactcgggaatagattgtttttacgtggattttgtcggataatttagtagcaaacggcaagtgatagcgattagtgctttttccattgccaatataagcaattgttagcatagtttaaagcccccatttttcatgatagttccattatagtcaaacaaacgatcagatggaagcaagaatccttctcgctgtctatttgtatgtctccttaattaactaatgaaacaaagcgcttatcattttgaaacgaataggctatgattgattcaaaaaggagaaaacgatgagatgtcctttttgtcagatcgcagccagacagcttcctgcaacaatcatttatgaaaatcaatggacaatggcgattcttcctaaaaatcccgctgcagacggtcacctcttagttataccgaaacaacatgtaacttctattcttgcttgtgacgaagaaatatggatgcaagttaccaagacagcaaaaaaggtggcaacagattgcgtgaaatctggtaactttgaaggtatcaatttcttaagtgcccatggcgctgctgcccaacaatccgtcaatcatctgcatatccatttgattcctcgaaaagaaggcgacggcatcaatgcttggcccgattttcatgacagtaaaaagtaagaaggttattaacgagtcgtcaattgaacaatgaaagagagaatgatcaatggatattcagttagaaaaagttacctaccaaacattaccgatagcgtatcggatacaaaaagaaagttttaaacagttgtttgaacactatcaggatacagaaacctccccttatctggaaacgtatgagaatttctctaaaaagtaccaacgagagaataattatttctatttgatccaagccgacggatcagcagtaggttttgtacgaatcgttctatcagaagccccggcgctggtagctcgagtggcccccatctgtattttgcctgctaatgaaaatcatgggattggtaaaatggccattcagttagtcgaagctaaattctcgtctattaagacatggcagctaagtacgattttgcaagaaacccgcctactttcattttatcaaacactcggttatcagctatcagatcgtacgagtccgattgtgactggtatggatcgtgtatttcttaccaaacatatccactaaaactcattacttattatcttttctccccattacctatgacagagtctcttaaagagcgactgtcataggtaatcttgtttacataatattatactggtaaataaaaaacacttcttgtttccttgatacttttcgagagaaagttcaaacgagtttgacgaaaaggtctcatacaagcgttttttggacccactcattcgtttttctcaactagcttttatcagtttctttccttatttatgcaatttatttcctagttccttttcatcatctttctataatgttgctgatcttatgttataattaattatgtattttaaaactagataattactataagagaaggtggatttatggaacaacatcaaccatcctggataaaactgctttttttctttttgattcttatgggagcagatcttatgaaacaggttatcgttcatcatttcgcttggttagacgtgctgcaattaatgaatttcctaatatttattctactctcctttttcattcgccagttaccttctaccttgcgaaagattctgattggtacttatctttttattatcggtggaatcatgtctcttttatttggaaatccctttgaacttgcttcatggacactctacttcgtgggtgcgttttttggtacatttttgtgggatcatttttgtcaacgatttagacttcgttggtttattgataaaataattcgttaaaggagcgaatttcgatggattggcgcaatgatcggatcaaagcttgtcaaaatggaacaaatcccatgttaatgaaggaattatcgggtggttttgcggtttttggcgatacccaatttttaccaggctactgtgtgttgttacctaaaaaatcagtcggaagcctaaatgatttatcactggaagaaagacaagaatttctcgtctcgatgagtgttctgggtgatgccattttagccgcctgttcaccactgcgagtcaattacgatattcttggcaacacggatcaatttcttcatgcacacgtttttccacgatattcttgggagaccgaagagcgtcgttcaaaacctgtttggctatatccagcaacatattggacatgtccgcagaatacctatgatgaagagaaacatcacctcatacgtcagcgaatcacgacttctttgactgaatccgttcccggtgatcaatgagagctcttgaccaggagctttttttgttgataaaagaatttttcacaactctgatagaaaacagttgagacgtccgtataatagacaaagaggtgaaaaaatgaacgatcatcaaatgattcatttgatcaagaacaaagattataccggcttggaacaactaattgatagatacgggtcaagtattcttatgaccatccatcgaatcttacaagcccctcctgaacaaagtgaatggtcagatgtagcaaatgaagtattttatgaaatctggcaaaaaatcgaggcctatgatcctgagaaaagtagttttatcacttggatcttgctgattactcgaagtcgcggaatcgatcgcaagcgtaagttaaataaagcatttcaacaagaaagtattgaagaatatcaagagctagctattacggaatccccgttaagtgaagaagaatttctgatttggctcgaagagttatcccaagtcgatcaacaaatttttcttttatattatttttatcaagaaagtccagaagagatcgcgcaacaactggatttgcagacaacagctatttataatcacttatctcgcggcagaaaattgttgaaaaagatttggaaagaaaggatgaatcgtgatgaattttaaacagatcgttgattcagaaaatcgtcgtctcagaaatgaagtaacgcaagatgaaaaaaatcgtcttttagctaatggcaaaacatatatcttttttcaagaattgatgactgaaattcaatcactcttagataaagacgaaacagttcaaggctatctccctctctcaacttcaggcaaccttgcaatcagtaatcaagggatagctggtttgtcttatgcacgtacagaaagagcaaagcaatatgtcgtacagttcaatgatactcggagtaatcgtctatttgttttttcagaaaaacggatcctttttcttgtgatcatcgactttttagatgatcaaacctatttcagttacccctactcctcgattccggcattttctttgaagacgcgtaaactgaatcgctttgagaaaccagaagacgaggaaatcatgttttgggcttactttgattttcaatcggatagccatatttttagtgatgtattgacaaagaaagactatcaactgtttcaacatttccatgacacgattcctgcactcaaaaaaattccaatcactgaaaaaatccaccgtaaaaatcccttagattacataatcagtaattggcatttcaattatcgattgatgatattcgtcaatcttttactaattcttttagctattgggttagtcttggggatcgtctttggaatcgggatttttaaagactggtactatcgtgatttgattgggtttgttgatcagagatcattttttgtccgataattatgttataatagtcaaaaattaacgagagaaggtctacctgttttatgaaaagaaaggtactagtcccattgctgctatccttgctattaagcggctgttctgcaaacgtaccagaagaagcaaccacatcttcgagcagccaaaaacaaatgcctagcgaaaccgtagaatcatcgcaatcttctctttcagatacaaaaactgttacgagggcttctgctagcgggtctaccagtgaatcggtatcagagacggagtcaccaaagactccagaaacagcaagcgcatatccctatcaagtagatatgtcacaacaatccaatgtcctgacagtttcttttgaaggattcaacgttcctgacactgttactattgatcagagcaaagaggaagttacttttgaaagttctacacccgatgattccgtgactagccgctaccgagcaacaatcgcaacggttcccacaaaaacaattcgcgtttttagtgtaggaacgaatcaaattcgtgaagtcaaagtgaatacacaaatctcaatcggtaaaatactgggtggaacccaagatcgtaaagactaccatggtacaatgtatttgttttacaaccatgatggtgggctttccctagcaacgccgaactatgctggcaacgttcctgcagatcagatggatgtcatgcaggaagttcttccctaaatcacttcataagaacctaactttcagaaccttagcttgactacaatattgcaggaataatcaaaaatttgttgtggaggaaaatcgatgaatctcaaacgttttgtacaattgtttatttgctatttcgtatctatggtggttgctgttttactgaccaacttattcaatatttcaactatgccattttatttgttggtggcctctattattgggtatatcacattaacgatcccgttagtagtcatgacgatcaagaaaaacaaatagttccgagagtggatttattgaaaggagcatcagatgattggcaatgttcgttatctaccaagaaagttaagaaaatggtacattctctatcttatctgtctgatacttatttatggctggttgttgtttactgatcagtcagcggtacttgctgtcgctattcttctcgttctttttgcaatcgaacttgcatttatgtggcattcagaaaattcttttttaggcagtgttctggttgcttgtcttctttatggcatctggatgctacctttcgtgcttcggtgattagttttcatttattcgtatcgaaagtgaatcggagaagctagcatagagaattttcttaaaaaaatacccagagaaaagagcaagtcatgacgttgtcattgacgataggtctttgcagtaatgcaaacactgagggctctattcctttgggtattttttgttcaatttaactaatttaacttagtgagtgacaaacaattattgctctcgttcaacaagtcggtaatagacttttgctgtgataagatataccaacagataaatgactgcgaaaagagcaactgatacaacagtcacactgatcagcagattgcggtcggtcaacccgaaaagcaaaagcagcttgcgaattatcggaaacgcgaatgcaaggtggatgatcgcagctaccaatggaaaagaaaaaatcatcaatacttgttgttggatcacttgcttgacttctttatgacttaagccaactttctgtaagatctcaaaacgttctttatcttctattccttcagagacttgcttgtaatagatgattaatgtagctgccaaaataaagatcagtccaaaaatcaaccctaagaaaaagaatcctcccgtaaacgttttggtctgtacttggaagagatcttttgattcaatgcgtgcattcggatcagctgcttgaaggtcctttcgtatctctttgaccattgtttctcgatcactggtttcaggcacttggaagtcaaaaacagtagtgatcactggttgttgatagataaggaattctttttcctgataccaactagttaatttctcagaaagccaagtatcatcgactaccaccacaagttgttgaacgggattctccacttgagtaaaaggtggcagctcagttagtgatcgaagagtgaactgactatgatcgatcgtcagctctttaggcaacgcttgatgggtccaagtttctggaaagaccaacaattcatctttttctggtccttcttttcctgtgattctttggtactccgtactagtaacaaatgtgagaaagaccgctttttctaaattctcgctgttatcttcaaaagttgttgaaggagtaagtgtgtttccctcaaccgtaaaaagtaagtctttagtagcagtgacttgtttccggtttttgagcgttactttattttcaagactatcgatggcttggttcaattgttgcagattcgcctctgactcgatctgaaagtcataaggaaatcgtgtttccaccacattcttctgtccgaaataaagactagctgttgtggcaacagtcactaaaaccattgttgacaaaatacaaatacttgctagacctgctgcattttgtttcattcgataaagcatcgttgatacattgatgaaatgggtcgtctgataataataagtggatcgctttcttaaaaactgcaatgctttaatactgccagaaataaacaacagatacgtggcgatgatcacaagaatcacagcgacaaaaaagagtgctaaggcgctgatgggcgacttgattgtgacagaaatcgtataccctaccgctaaacaaatgatccctagaagggctaaaaagccttttgctcgcggctcttgttcattgcgcttactaccttgcagcagttcgatcggcttggttcgccggacttgcagcatattgaatagaaaaaggcagccataaaccatcaaaaagtaaaggatcacaagaccgatactttctacagaaagttcaaagacgaaagattctcccacctctagaattctttttaaaatcaagaaccccaatcgtgcaaacaaaagacctccaactagccctgcggccagactgatgaggcagctataaaaaagttcccaaaagaccactaacgcaatttctcgtttccctaatcctagaacattgtaaagtccaaattctttttttcgttgtttgatcaaaaagttattggtgtaaaacgaaaaaatggcggcaaaaatcattaaaatgatatttcctagtcgaaacataaaaatagcactttgactgcttggcagtttattcattcctggattatttacaatgatttgtgtcatcattatcactgcaactagaagactcatggacagtaaaaaaggagtataagctttggtgttttttcgcaaattggaaaaggcgattttttgaaagaacattccttactcctcccttgcaaagacagctgtcatggtttccgagattgcttctagaaaagcgctattcgttcgttctccgcgataaagctgatggaagacgtgaccgtctttgatgaataatactcgttgcgcgcggcttgcagcaatggaactatgagtaaccatgatgatcgtttgtccattctgattgatttgctgaaacaacgtcagcaattgatcggaagtttttgaatctagcgccccagttggttcatctgctagtaagagatccggctttgtgataatcgcgcgtgcgacagctacccgttgtttctggccgccggataattcatagggatagtgttgtaacaagtcggtaattcccagtgttcgcactaatggttgcagtcgttggtccatttgtttgaccggcactttcgataagactaatggtaataagatattgtctttgacagaaaaagtatccaataaattgaaatcttgaaaaacaaagcccaaatgatctcggcgaaaacttgcagcgtctttttctttgatggtcgtcaaatcgataccattaagcgctaattctcccgctgtcggttgatctaacgtggccatcaagttcagtagggtgctttttccagatcctgattctcccataatggcgacatattcgccttcttctactgaaaacgtgatattcttcaatgcttcgaccggctggccgttcaactgactttgatacactttttttacttgttgaatgtttaatagtggcattgttctctcccccttcttttttagcataagctgtttagaagaaaaaagcgacttacaataaaaaacgcaaacttacagtgttgaaagtttgcggtcaaataaaatttttagtgggaaaatggatcgtcaccgtagttcccttccctacttcggagtcaatcgttagctgacagccgattttttctgctgcttgctggctcaaatataatcctaatccgctagcacgctgctgaaagcgtccattttgtcctgtataacctttttcaaaaacccgcggcaaatcttcttgacgaataccgatccctgtgtcttgaatcaaaagacaattgttttcggtaaaaatccggattccgcctttttctgtatacttcaggctattaaaaagcaactgctcaaagataaaagtcagccatttacgatccgaagtaacggtcaagtcgatagccaaatccagttgcaagtctttttttgaaaaaaacaaggcatattttttgattgcttggtgaatgagaggtgctaacacaatcggttcaaaaacaaagtcatcatttttcaagttttgtcgtaaataattcagcatcatttgcaaataatcattcactttaaatagttctgctttgacttcagtgggcgataggccatcactttgcactagcaaatccatcgctgctaatggtgttttgatctgatgcagccataatccgaagtcttcgtagatttcttcattcttcaaggctgcttgatactcggaggcggttttttctttagcttgtcgtttgattagctgctggtattcttcttcgatactgtttcgcgcaatcggcaagaaagccaaagctgcttcagtgatcattttcttggctaataagttttgtaactgacgtcttttttgtagataacgcatatattgccagacagagaaaatacctaaaatcactcctgtgaaaatcacataatcgatgaagggctctaaaggaagctcatggagaaagaacaagcctaaaagaccgctactaaacaaaattaaaaacaaatagaacttgccgtaaagcaaaaaatactcttttaagttaatcataggcttgttccttttcaatcaaatagcctttgtttttcactgtttgaatcaaatcagacaatccagtttgacttaatttctttcgcaagcgggtcatgttaacggctaatgtattattatcaataaactcttcgctattccaaagcatttcaataatcgtttctttgggaacgattttcccttgctgttgcaagagtaaggaaaggattcgagattcgtttggcgacagcggcaaagattccgttttacttttcagcaaattttctattggatgaaaagtgacatctcctaatgaaaacgtctggacttgttgatgggtatattggtagctgcggcgcaacagcgcttggatcttagccaaaacaaacgccaaatcaaaaggttttgttaggtaatcatcggctcccatgttcattgccatgatttgattcatttgttgatccattgaagaaagaaaaatgattggcacttcagaaatgttacgaatttcttggcaccaatggtacccgttgtaataaggcaaagaaatgtccaaaagaatcaagtcgggacttaccgcacgaaattcctgcaaaatttcagcaaattttttggcgggataacactcatatccccattgtcttaaataatcagccagtactgaaacgatcgtagcatcatcttctacaaggtatattttttgcatgattctctcctatcactaaattggtgaagctatcacagacagtgtaccagaaaataaaaagaaacgtctagttgagataaatcattctagacgtttctttttatttacactttttcattcgactcactttttttaagtgcattgcggattgatgggacttgcttgattttcattagatctaataagaaagtaaatagtgggatccccacgatcagaccccagataccaaagagatgctcacccagatataaaacaatgaacgtatagaacatgggaatctctgttttatgggacatcagccgcggattgagaacataggactcgagagcatgaacaaaaataatgattaataaaacatagacaacatcattgagtccgccaatcgtataggcaataaaggttaatggaatacaagaaatgatgactcctgctactggaatcaagcttaagaagaaaatcatcatggccaaacttaacagctgaggaaagcccatgacagctaaagcaagcactgtgatcactgtattaacgatagcaatcaatagctgggtttcgatcacacttccgaatgcgcgggtaaatttccttgcgagatagtaaacatcctcaaaaaaccaggaagcactcccttgcaaaaagagctgagaaaatgccactgtttttttgttgtcaatcataaagaaaaaactcaataagaaagagatcaatacagtcaaagccaattcaccgaagttgtaaagataattgatgacgacgacgactccattttggattttttggacataatcgcttgtttgcaccaaatgtagcaaatactctaataactcattgttagagtctgctttttgataaaaatcggtcactgacttaaccagttgcgcggattggttcaaaagaatcggtgcatacttggtaatgactaagtaaaccaaagcgacaacgatcaagtacaacacgattgaaagaagtttgattgacacattcactttcttgcgtattagctggaccagtttgtaaatcaaataagtaaaaataaaggttaataaaataatagtcatcatactgcgaagcagaaataagatcccgcaaagaaagatcagcactgtccaacgtcttaatggaacattggcaacaaaccgatggtagtaattcatgaacacgctccttttttcaagtcgtcaatcaacgactgttacttcattccccaattaatctaaccactttttgaagcaattatcaactcaaatcaattaagaagactattgtgggtagagtcatatgctaaagcaaaagcagcctgctgtcagtggcaactggaccaagtatcgtgaatgaaggactgatgattattttcaaaagataaatgcctattttttcgaaaagtttatggttgttttaaggttactatgacacaatagaccttgacagaataatttacagtctgtcttagcggaaactaaggcagacgccttttttatcaaaaactgccctttgttcggtttgtatcgaacaaagggcagtttaaacgattctatatttattcttatcagttgttactcctagacgaattgtctgctttccttaaaaggacgctcactatgcgactagctcactatgactaaagagacaattcttgacgaacttctcgaagaatggcatcaacggtcaacccattttcttgtagcaactcatttgcttgataacggtcatgaaaggctttatctaaaccaaaattgacaattttgatcggagattttcctaaataactagcgacagcttgtccatagcctccttcaagaaggccatcttcaagagtgagcaacaattgatgtgtagcaattaagccagacaatgtgtcagtatctaatccagaaataaatctaggattaatgaccgtaggtgtgatcccaagctcggtttctatcatggcagctgctttttttgccaggccaagagcatttcctacaccaagtaaggcaactttgctgcccgcttgaatgagttgatttttgtttagttgactgtaatctgtttgatcgacacgacctgattctaacggaccgacaggaacgcgaattgccactgggtgttgggattggtcaatagaccaatccagcatcgctaaatattcttccttattggtcggtgcaagataaacaagattcggaatatgactcaaaaatggaatatcaaagatccctaaatgactttcatcattcatgccataagctgaagcgccataaactaaaatagttcccgccacattgttcaaagacaaatcatgagagatttggtcaaaacttcgttgcataaaggttgaaaaaactgcccaaacgggttttgctccattttttgccagaccggcagtcatggttgcagcatgttcctctgcgatcccaacgtcaacaaattgactgccggcgatttttcgttgttcaggggtaaaaaggatcatcggcgtgccagcatttactgcaacgactgttggatcctgtgccattttttctaaaagataatcggtcgttaccgttgaataagtttctccaccagaatttgcaagataattccctgtttcaagactaaatggtccaccagcatggaatttctcgcgattttcttcggcaaatttgaagccttttcctttaacggtctgaatatgaaggacaacaggatgattgctgtctttcacttgtttgaatagatgcatcaaggctgtcagatcattgccatcagcaagataatagtagtcagaccctaatgacttaaagaaattgttttccgcttgaccattcgtatctcgcaatgctcgtaagttattgtagagacctccgtggttttccgcaatcgactggtcgttatcatttacaatcacgatagtgtttgttccagtctccgcgatattgttcaatccttcataagccagaccaccagataatgagccgtcaccaatgaccgcaattacgttcccttcttcattttttaagtctcgtgctttggcaaccccatttgctaaagacaatgacgtggatgtatgccccactgtaaacaagtcatggtcactttcttttggattggtataaccagagacatcgctataatgcgctggatcccagaaggcttgacctcgcccagtcagcattttatgaatataggtttggtgagaaacatcaaaaatcattttatctcttggagaatcaaagacagcgtgtaaagcaaccgtcatttcgacaacgcccaaattcggtccgttatgtcctccatgatggctgattttttctaataacacggttcttgcttcctcactaacttgttgtagttctgcaacggataacttctttaaatctgctggatctgtaattgattttaataacatcaaaaaactcccttctctgtttgagagtatactgcttcaccttcactttaagtcaagaaacttttgaaactttttcacgaaagtaagcaacagacaggtagaacacatgaacacaaaaaagcccacccttcaacttgtcatggtgatctgttttatcagcagaaaagttgaaggagagactctttcaaaagcattcgttatgagacacgatcgttttccagcgttaaatgatgtaagtcaaatcacttgcaggagttggataagcaaagatcagcgcttcaatttcttggtgagtgagctgtttttccagaatcaagtagcacaaattaatcaattcatctgcgatacttgaaagacaggtaatcgcaatgatttgtccctcttgattgtaaacaagtttaagcatcgcaacaggatcgttgatgcgacggtacgtaaaccaatcggcaaggttgattgtttcactatggatctgcagattttgagcgagctgtttttcactttgaccgatccgagccaatttcaacccaccaaagacgattgtaggaatcaggggatacgtgattgcagaacgagaacctttttggctcattgaagcgaccgcatattttgcttcaaaacttgaaacaggcgtcagtttaggttgttccttatccaatacatctccacaggcaaaaactcgtgggttcgatgtttgtaaatagtcattgactttgatcccgcgtttggaataatcaactcctgcattttctaagtgtaaggattcaacatttgggatgcgtccagcagcacttaccacgtaatcggtgtccagctcaaagcctgtaccttgcagcgtgtatccttcattgatttggctgatgctttcaatctctacattgaaatgaaaggaaattccttgcttttgtaattgctcaacaaaggcattcaccaattcttgatcaaatgctttcagtggtctgtcgttatgatgaataatgtgtacctctgctcctgctgcttgagcgattgtcgcaagttcaaaagcaacataccccgctcctaaaaaagtgattttcgcgggcattttttccattgcaagaaaatcggtgcttgtatgcaaatattcttgtcctttaatcgggagtagcgcaggtcgttgtcctgtagcaatcaagaactgatcagctgaaacgatttctgaaccaatccgcagcgtttgttcatcgataaatcccgcttctccttcataggtcgtgattccagtatccactaagccctgcttcgtctgtgtgggaacagtgtccgtgtaactgcgcttgaaagccatcaaagttttccagtcaatacccagctctccagtgatcccttttcctgctaagtgagcagccttcgcctttgcttcaacggcactcattaaaatcttcttggggtcgcacccgcggttggggcaagttcctccccagagatcggcttcaacgattgcgacagtcttcccttgctcgctgaaagaataagccgcagcagttccggatggtccaccacccacaacgattacatcatagttttgcatcttgctcctcctgacttagaaaatgaaagatatctgtacggctaacttcaccaatcgcttgtccttgttctgtaacaaccaaatgttcgtggttggccaagacttcatatacttgtgaaagagggactttcacatcgagggacattccctcttgtgtagttgattgttggtagtaaccagaatcaataatcgcttgaagacgttgttcttgctgtgctccttgtgtttcgtcaaaaaaggcgcgaacgaaatccgtttttggctctgtccgtattttttcaggcgtatcacattgtaccagtctgccttcattcatcacaccgattcgatctcccaattttaaggcttcattcatattatgggtaacaaagacgatcgtattgcctaatttattatgcaaatctaatacgagatcctgaagattggttcgagaaatcggatcaagggcgctaaaaggttcatccatcaagatgatgtccggttctgcagccaacgctcgcaagattccgatccgctgactttgaccacctgaaagttcagccggcatccgttttttgaacgtctctggttcaagtccaacctcagtgagtagttcatcgacacgttgattgcgacgatttttatcccaaccgagcatttctggaatgatttcaatattctccttgacggacatcgttggaaataaagcaatttgctgcaacacgtaaccaattttccaacgtaacttttggagttgatagtctttcactcgtttttgtttgaagtaaacattgccttccgtcggttcgatcagcccattgatcattttaagggaggttgtttttccgcttcctgagggacctactaagacaaagatttctccttgatgaatggagagatccaattcttttaatacgacttgtccctcaaattctttgacaacttgtttaaattcgataattggttccatttagtttccctccccaataatcttttctttttttagaaattcacgagcaacatctgccggttgttttccttccacattcacttgatagttcatgtcaatcatctggtcctctgtgatttttcctgatagttttttcaatgctttgacgacttgcggatgttctgcagcaaattcatctttcatcaatgcggctccttgataaggtggaaagagctgtcgatcatcttctaaaacgacgagattgtattgtttgatctcactatctgtcgaataagcatcgatcacatcgacatccttgctttgaatcgcttgatagcgcagtgccggttccatactttggacagaatcaaaagtcagcccgtactgtttttggatcccgcgatagccatcttcccgatcaataaactctaaagtaaaaccagcccgaagctctgactcatgagcaactaattcagaaatcttcgttatacccaactcttctgcttgttcacgacgcatggctaaagcataggtgttttcgtaggtcatcggctctaacaggcgcatattaaactggtcactaagcagttttgttgcttcttgataagttgattctggagaaccatctatttgggtattttctgggactttgactagactttctaatactgttcccgtaaactcgggataaatatcaatctggtcattttcaagggcgctaaataagaaacttgttttaccaaagtttggtttgatctcgacggttaaactaggatcttcttcttcgatcactgcttgatacatattgataaggatatctggttctgaaccgagtttaccagcaatcgttaccgttttatttgaaataggattatactgtgcgaaaagaattccgccgattccaagaaagataacacctaaagagatcagtgtggttttcatactgcggttttgtaaaaaacgaatcagtccactgaataagattgctaatagagccgaactaaccgcccctatgagtgtcaaactcggatcattacggtcgatccctaacaaaataaaggttcccaatccaccagcaccaatcaatgctgccaacgtggccgttccaatgatcaacaccaatgctgtacgtaccccagaaatgatgacaggcattgcaataggtaactcaactttgaagagttttcgcaagcgagacataccaaatgcatccgccgcttcttcaatcgacggatcgatttcggaaagcccaatatacgtgttttgaaaaatgggcagtaacgcataaactaccaatgctattagagcgggaacggtgccaataccaacaaaaggaatcaataatcccaataatgccaatgatggaattgtttgtagaatacttgtgatctgtaaaacaaattctgccattcgtttcttttggctcaacaaaattgctaatggaatagcaattaaaatggctaaaatcaacgcactcagcgaaatggccaagtgttgaaagattgcccgcagcaactcctcctttcgctcgctaaacgcttgaatgatttcgttcatatattccatcctccactattctagtctgccttaagtatagctgaatgcccaaacgcaacaaaaagatacgctcagcaggattgggagaaaagttggcctttcgcatctaaataggatccattatttcctgacattctgttacaataagtctaaaagaatgaggtgcttctatgccattactggttttgattggtgctcaggctgttggaaaaatgactgtcggtcgcgaactttaaaaaagaattgatggtaaattactatttaatcatcaaactattgatttatttgccaattatcttgggtatacgcctgcggcatttaagttgtctgattccactaggatcgaacttttcaaagcatttgtggctggtgaacagaatacagttaagacaatcatatttactgttttagtgggatttgatcagaaagaagatattgcttttttacacaaaatttgtgagatctttttaagcgctggacaaccggtttattttgttgaacttgttgcgcaattagaggagcgcatcgcacgtaaccgtcaggaagcacgtttaaaagcgaagccgtcaaaacgggatcttgctttttcgcatcaagaacttcttacttttaatgaaaaataccgtttggaaagccattcgacggaattggcatccctttttccaaaagtaaaaacgatgaaaatcgataatactgagttgtcacccgaaatggtcagccagaaaattattgctaacttccaacttgaatgaaagataagaaggacactaatcttaggaaagcagattagtgtccttctttattcttattttagtcaaacatccgatgtcgctgtgaaaaaaccatcagcaaaagaaaagacttccccaagcacttctattactgatggttattaaaattcacgttgcctttttatgataagcgacgtgtattgacactaccaaatctattttttcattccttcatgaatattatgactatcgtataaaaatgaataatcagctgattcgagtttccttctataaaatcatctttctacctgatatcctatcacttagggaaaaaatagtataatcactttttgcactggaacatgaaaaaaagaaattaaagactttaccacttttttattctcagtacttgaaaagctactccatctaactgatcaatcaatcatactaactcctgtcaccggtacaagcatttctaagttgattgaccatgatcatggtcaatcaagtctgtcaatccgcatatatctatattagtactactgattatttatctttttatagagacttatagccctttcaatgctgcgctgcttatttggcgattgaaacgttatgtgatttttttagttgaacataagcaatattcaaaataaagccgacgactgccaaagcaattgctgtatagaatgcgtttgtaaaatctccattgttgctggcagccattcctgctgctactcgtggtccaaagaaagcagctgtagaataaccaacaaagacgattccatagttgactccttggttagctggtccgtaattttccattacgatcgatgggaaaacccccatcactccgccaaagcagagtcctagcccaatgattcccactgcaaagatcatcgctgcacttgaaagtgtcaaaacgagtaaagataacgctacgacaccgtaaatgatcatcaatgtattggaacgcccaatcttatcagaaactgttccccaaatcactcgacctaagcaattgctaaaagaatatagactaacataaaaagcggctgttgtagctgttaatccgaacatttcctgcccaatcacagcagcattggaagcaatcatcaaaccagaaaatgccccaacaccgagcatcaagataatcaaataaaaagcaggtgttttcatcatctcttgccaggaataatttgctgcggttcctttaaccgcagaagtttgtgggacccatcctgctggacgataatctgcaggggcttttttgataaagaaacttgccattacaacgacgatcatataagcaataccgataaaacgaaaagcagtcaacacatctcttgattcaataattgcattcgcgatcggtgcggcgatgatggctgcaccgcccatacctgcagtgatcaatcctgaagcaagtccacgtttgtctgggaataaacgaatcgtattacttaagcaagcagaataagcaaatccttgaccaagacctgaaagcacaccataagttagatagagcatcccaggtgattccacaaatccagttaagaagaaacctagcgcaaataataaaccaccaaaagtaatcgtccattttgccaatccacggtcggtcaagaatcctcctaaaatcattgtgataggtccgacagcagcattgattgtaaatgccagcatgatttcttccattgtccaattttttagttgactaagcggtccagcgaaaacgctaaatgcataaacggcacctgtacataacagaacagcagttgaagcaatcaagactagccaacggttgagttttgtttccatgttttacccccaaaaaatagttttgtttaaataaattgaatgaatacacctcatgttacttatttcacataacgttttgaaagaaaatgtgcagtgcgattctctgcacatttcttttaacctattaaagattttctgcaactgctgtcttaccagcgatccgtccaaaggtaaagatatcagtcaatgagttaccaccaaggcgatttcctgcatggattcctcctgctacttcaccagctgcatatagacctttgatcacttgattttcttttgataacacatgggtttgtgtatcgatctttaacccccccatggtgtgatgtactgccggttttcttggagttgcataaaatggagcagtcgttactttaagatcaaacacatctttgccaaattcaggatcttttcctgcatcgacataggcgttgtatgcagtgatcgtttctttcaagatggttggatcaacattaatttgttctgctaattcttcaagggtatcggcgcggaataatgttccgttagctacttgtttgtcgattttttcttgggacgtattgtacgctgttttcttgatttcttcatcagcaatcaaatagaataggccaccattatcgattgctgcttgtgtcaatacatcacggctttcatattcattgacgaaacgtttgccttcttgattgaccatcacaaagtttgcgggaggtacttgcagaccgctgaataatgctcccgtattcggatcagataccggcatcatttgtgagaagcccattccaactagatccgcaccggcactttcccctagtttgataccatcccctgtgattgccggcgaattggaagttttgatgtcatcttcgatttcagtccaatacgtgttgtactgcttcagcatttgtgtattcgcaccgaagccaccagaagctaagataactgctttggcatggatcgttactttttgtccattgcgaccttccccaatgatccctacgacttgtccctcttcgatgatcaattctttgactggtgtgtcagtaagaatttttccaccattttcattgacgaaattgtgtagggcagaaacaaaagcgtacccttcatttttcaatggtttatggcctcggcgccattttgctccaactggcatatcgacatgtttgtaatcaaattcaacgccgatttcttctagccatttcacagactctagtgcacgatcagttaggatttttactaagtcatattgaccgtaaatcacatttccttctaagtcggtccgtttgccgcctaaataagtttggatacgatgccagatggcagagtcaaataagaattctttttctggagtcgttgcttgtaaatacgttgtgatttgttctttcaacaatcgaaaatcagccaagtattctgcatcaatggttgcttcatctacggcaatgatttcttctagcgcagcccgttcacctggaagcgcagcaaatgttttttgccaatccggatctgcggcattcattggtccacccgtgcgaacggtattcccaccgatggctgggtatttttcaactaaaatcacctctttgccttcttggaggatacttgctgcggcactcaatcctgccccaccaccaccgacaacgatgatatccgtggtgtaagtttcatcttccgtttttagcgcactggctgccttaggacgttttcttaaaacatctgggtttgcaccagccattttcactgctttcgcgacaccatcaacgacaccgttactggtaacggaagcacctgagatcgcatcgacgttcaatgtttggccttcaatgatttcttgtggaacacgcgcaaagactacatctgcgattccttccgattcaccggaagtatcgatattgattgcttcgatccgttcttcacttaatgtaaccaccattggtaaatcaccattgtgtcctggtgccgtgacagtataatccccaggctgataaactacttcttcgggaacattcaagatattagcaacttctgtaaagcgaatgaattttctgaaacagctttccaaaaagtcaacagtccgttgatctttcagctgcccattttcatcgaatgcttgatgcgcacgacctaaaagaaattcattaccaggcataaccgttgcattgacaccaggtgcatcaagaatttgacgcaagtgtagttgtgcccgtgaagaaccttggacgtcataagaagcacccacgatcatcactggtttgccatcaaacgggtgtagattgaaggacaaccattctaagacactttttagtgcggatggaatggaatgattgtgttctggtgtcgcgataatcacgccatcggcagccaaaattttctgatttaatgtttgaatgacttcactattggtttgatcctctgtttcattgaacataggaacttgatcaatttctaaaatttcgatttctgctaaatcggcaaatgcttgttgcatatatgtcaccagttggcgattagtcgatttctttgcatttgtaccgatcataccgacaaatttcatggacatttcctctctttcttatacctgttcccaagaaaatttctttgagcgctctttggcagtcgaatattcactgacgagacgattcgtgatttccacgaataatttgaattcattgaagcagtcttctaattcagcgactttttcctcatcttttaagcatccttcttcatcaaaggcttgcatcgaatgaccgagtaaaaattcggcactaggcatgattcgtgctttgacttccggtgcatcaagaatttggcgaaggtgtgcttgcgctcgggaagaacctaaagcaccaagtgaggcaccagtgatcatcactggtttgtcgatcaagggacgggtcgtataagaaagccattcaatcatgctttttagtactgctggaatggaatgatcgtattcaggtgtactgataatcacgccatcagcagcctcgattttttctgctaattctcgaactgcttcaggtgctgttctgtcttctggttcattgaatgctggcagatctttgatttcgcaaagctcgatttctgcctgatctttgaaatgggtttggataaattgcaataactggcgattggtcgaacgtgcagagttagtgccaacgattccgatcagtttcatactcatctctcctaaatgtgataaatttaacaattgattcgattataactcgcttttagatcaattgtttcaaaagttaatcgtacaaatagtcgtcttagaaagataaaaatggtcaaactcagcttaaatctctctgatttcattccgatagaaggatctgaaggacaatttatttgttccaattaagtacttctacagtttagtctgaccattcacatttgtgaaatatttatttaattatattatgataacttttttgttataatagacatatttctacggaaggagcaacttctatgtctcttaaagattcccatttgatgctgcagtacatcgacacattactaaagtacaataactataccaaagcagcgaaagacctatttatttctcagccttatcttacgcaagccatcaaaaaagtcgaacaagagttgggaacggccatcattattcgtcagtcaggtgttttgcatttgactgaagccggtaaaatctattatcaataccttgaaacattggaaaccgcttccgcgaaatttcgtcatcggttactgcgctacacatcaccagaaaccaaaacattgcgattgggtatcttgcccagtctgggctcgttcttgctcccactttttttacctgactatttggcagaacaccaggatgtgaccgtttttttgcgtgaagatttgccaaagcacaatgagaaacgtttattaagtaatcaattggatttttttgttggccaaaacccggagactatttcacctaatttgacgacttacgccacaaagagtgaaaattattttgcgatcatcccccctatttcgcctttgtatcaagcaaacaaaaaatttctctctcaagacagtgtttcaatgaaagaactgttacaaagcccgttgatattgacgacaagcggctccgcgattcgtcggcaaattgatcaattattgaaaaagtacaaagttgaaccaaccattctcgtagaaagcagcaatatttatactgcagcagcacttgctgaaaacaatctcgggttggccatcgttcctgaaagtgtcttgcaagcagcgacaatgacgcctttcaacctttatccgatacctgaagaaatgctaacgttaaattattttatcgctcatcaagcagagcgtccgttatcgatagctgatcaaaacttgattcgctattttctagaaaaagtatgatcgctaaaaccgccatcaaaagtaaaaaaaacatactcaaagaagaaagagtcagaagtaatggtatgtcaaacgagctaaacagattaagcaggcactttaagatcgtgcaattgccagggggcgcagtcgttctgctatcttgtttcaccagtttaaatacttcattttacttcatttaccagactctgaaagctgctttgtcaaggcagtttcgtctctatctttgagtatgtttcaattaggctttttgattcgtttcaggtaactcaatcagtggttgtagcgtagagggataaagcaattggccttgtcgggttacgattaatccagtgatgccatcgagttggctgagttgtttcatgatttcttcagtttttttaccaaagagacgtgtggtccaaatttcgccatccactgaacgatcggaaataatcgtgatacttgctaacgctgattctatcggataaccggttttacgattgaaaatatgatgataggtcttaccgtcgacggtgtgggaacgttcatagatccctgaggttacgatagaacgatcgcggatttttaaggctgccacgaaatttcctcttggcaaaaaaggattctgaattccgatacgccataagtgatccgcatgatttggtgtttcaccaaaggtaacaacattcccgcccagatcaatcaaagcggcactgacaccagattgcttaaaaaaatctgccagctgatctgcgaaatagcctttggccacagcacctaggtctattgacataccggcagctaaggcaacgctctgctgttggttatccaattcgattcgttgaggatcggtcacctgtagtaattccgtcactttttcggcagtcggcactttggcatctgagaaaccaatacgccactcctgaaccaggggtcccatcgcgatgttcaagaaactatcctctggcaagctgtgctcttttgctaaggcgatcaaagcaaacaagtctttggctactttggtcggctgaattccggcgttttgattgactttcatcagatctgaagcaggatcattggcactaaaccgtttttcaaacgctctgatttgttggactgctgcttccaaaattggtgtgggatcttcatgttggatccaaagctgaatgatcgttcccatcgctttgacttgtctttttccttcttgcatccgttcgtttcgcccctagtttttttgttcatcatagcagtttttcagaaaaaattgaatgcctttagcaaataaatgcaactataagaaagtcgcggacaggctttaaaacattaaatcacccggttcaatgaaatcatttcgatcaatccttgcgccgcttctgaacctttattgcccgctttggttccggcccgctcgatggcttgttcgatagtttctgtagttagaacgccaaacatgactggaatgtctgccgctaatccaacttgggccacgcctttcgcgacttcattgctaacaagctcataatgggtagtcgcaccgcggataactgcacccagtgtgatcaagccatcgtattgcttcacgttgactaatttttttgttatatagggaatttcaaaggcaccgggtacccagtaaacatcaatgtcttcttcttttactccatgccgtatcaaattgtcttgggcgccactcaaaagtttcgccgtaataaactcgttaaaacgcgcaaccacgatccctactttcattccttgtccgtcaaatgttccttcaaattgtgtcatgttgtgctctccttctttctcaaagtgataataaatgatggaatttttctttttttgtttgaagataacgattattttctgcaactggagttatttctaacggaattctttcagcaacatgaatgccatgagcttctaactcggtgattttttctggattatttgtcagcaagcgaatcgtatcgatgccaagagacttcagaataatcgccgcaaaaccataatcccgttcatctggacgaaaacctaattcaacattggcttcatacgtatccaagcctttttcctgtaattgatacgcctgcagtttctgtttcaagccgatacctcggccttcctgacgcaaatacaagatggctccggtaccttctttttcgatttgacgcatggcttcatgtagttgttccccgcaatcgcaccgctgggatccgaaaacatctccggtcaagcattctgagtgaagacgaatcaataatggttttgcgggattagtcaaatccccttttgctaatactaagtgctcaagatgatgctgatcttcaaataaggttaaatcgaaggatccaaatgcggttggcaattgaacggttaactgacttgttgccatataagtcgctaactcttcgatagtgatcatcggcagctgccatttttccgcgaattgagccaattgtgggcggcgagccatcgtgccatcctcatttagaatctcacaaatataggccgcttcactttgattggtcaattttgctaaatccaatgcagcctcggtatggccccttctttccagcaccccgcctattcttccgatcaacgggaaaatatgacctggtttttgaaagtcctcttccttagtttgaggattagccaatgctcggatcgttcgcgcgcgttcttcagcagaaattcctgttgtcgttgaacggtgatcgacacttatagtgaaggctgttttgaaagtatccgtattttgcgcgaccatttcagttagctgcaagcggtcagctagttgagctgagataggtgcgcaaatcaaccctcgagcaaatttcgtcataaaattcacgctttccatcgtagctagattagcgatcccaacaaggtctccttccgcttcccggtcgtcatcatcagcaacaataattaattgcccatttcttaaatagtctaatgctgtttcgattttatttttactcataggacatttcctttcttccgccacggatcagttgattggctttgacatattttcctaatagatctgtttcaacattcactgcttcaccgcggttaagtcgccccagattggtttgatttttggaatgaggaatcagtccaacggagaaatagcgcagtgtggtctcgataatcgtcaaactaaccccattcaatgcgatagagccctgtggaatgatctcatttctcagttcgtcgggataagcaaatgtcagaatcagcgcattctccaacacacgcttttctagcagcgttgtcgtagtatctacatgacctgccaccaagtgtccttccaagcggccgttgaaagctaacgctcgttccaaattgacttcgtcattgatttttgcggtcgaaaaggtggttcgttgataagtttccggcatgatctcgacagtgaattcttgtttgccagtcttgatcgctgtcaaacatacgccattgatcgccatactatcgccaacccgataatccgttaacaatgcttcagaagcatgacaagtcaatgcaatggtgcgaccactaggcacgatccgtgtgatcttacccttttcttgaatgagtccggtaaacattttcctgcctccttccaacgatccttaactcttctccgaccggttcaacagtgacttccgttagcgcaaacatctgattcacttctcgagaactagcaaaactcgctgttccattgccgccgataagttttggcgaaagataggtgataacttgatcccaataaccatccgccagaaaggcatcatgaatgctgcttccgccttcaacataaaccgattgaatcttgcgtcgatacaattctttcatgacaaacgagagagtcagtgaaggcgtggtaatgatattcacgtgatttgagaaaacagattggacttttttcgtagtaaagaccagtacaggactactggtatcctcaaaaagagttagctgctgtttcaaggtttctcctttacgatctaggaccactcgataagtcggaaaggcagcctctgtccgcaaagtaggattatcgattaaggcagtgcggctccctatcaaaatagcctggtagtctgaacgttcctgacgaacccggcgcaatgcagcttcaccggttatccttgttcgctgaccagccaaagcgatttttccatcaagtgtggttgcttgctttaaagccacaaaaggacgttgctcttcgtgatacgtattatagtggcgattgatttcacgtacctccttttctaaaacaccggtgatcactgctactccttgtgattctaaaaacgctttgcccttgccagataccaacggattgggatccaattgaccaattaccacttttttgatgccgctttgtagaatagcagttgtacaaggtggctgttttccgtaatggtggcaaggctcaagggtcacataaatggttgaatcaattagtttttcgggggaactacatgaatcgatggcgttcttttccgcatgtggctggccataagccatgtggctgcctacagcaactatttcctcatctttcacaatgacagcaccgactaaagggttcgtgaaggtttgtcctttgccttttagtgcttcggatatggcgcgcttcatatacgtttcatgcataaacattcctcctttctttaaataaaaagacctcgtgcataagtacacgaggtcttgattagacaaactcaaagaaacgatgacaaaaagaatagactcctcccgtcaatattcttgtaagtttttcttctcccatccagactttaactgtcggttccagagtttcactggatcaaccgcacgaatgcgggtcacggacttcaagcattgcttgtcaccgtcggtcgggaattacaccctgccccgaagaaacatattcaattcacgttagatactactattttttaattcaggtgtcaaacccctcttctatcctttttaaataacaattaaggaaaatgtttaagtacaacattcgccgttatcggagaagactttaaaaagttttttaggaattagcgacctccaaacaaacaattaaatgaggttccctggataaattatttctctttttatattttatttatttcgattgaataacacgtttttcgaacagataaaaaaagacttttaaagagtttaagaaacaatctctttaaaagtcttgtgaatggaataaatatgttattttgctgtagtgaaataaagtttctgactcgttaagttttccaaagaaagcagaaagaaactggcagctaataaattggcacttccgccgggtgaaacattttgctgttgacaatagttgttcaatgcttcaaaagcggcgctaggaatgggctgtttattggcttgctccacaatgccgtcagaagtactaaagtattctttatctaacaagttttgattttgataaatgtttcctactacctctaatcggtttctagcactcatcaactctgtatcataaatatgcttccctttgattctatatgcaccgctatcgattctgtatacttgtacatagctgtgccagtaagtatcactgtaattaacggatgaacttgtatgcaaaagaacatccccctcaaaaatctccacgccgttcttgtctttcaagccagtggattgcatgaggaatgaatcaattgctggaaaagtatgatcttctggataatctccgcttacatcaagtatgtttataccgtcatcatctaactcaaaacaaacgccttctgtacttggataaatcattctgtcattttctttatcccacgctctaaattttggtaccatcttatccctcctgctccaaaggcattatttcaatttgtgtgaatgtatcctttttttcttcgatttctttcgccaacttcttcgcaagttttaaactctcgcaaacctttttcagttgaactctcccagaaaatggattctcaacataaactaaatacacaaaactattcttagacatcttatccctcctgtttgctatcgctgacgattgcggaaatttactactatcttttattatttaccgtcttgcaatactgtaagggttgctaactttccttaatgatataatttgattattaattaaaaaggagtctttttatggacaaagtaaaagaagtagtttcagtaatactaatatttgctttgatatattttttgttgtgtctcgtcgcatctctcataatcagtttttttagattagtttttaaaagagaacctttctttgtaaactttaaagaattgtttcttaacttgtttttagaaattttgaatccttttaattatctgttctgattaaagcatttcgtcggataactgacttggtaaaatataaaatatgttacaatacctaaaaggaggtattgctttgggaacttttttagcttttatttggtatatttttataggatttatgctttatggaatcatcagattggcagttaaacacggaatttccgattccaaaaaaaataatttatgattctgttgctactcttttagagtagtttttttatttccgcaatttttggtggataactgactaaaccagcgatccgtcaactgccaataatgtcggttcattgtcattaatacaatcaaaaacttgcacctctgcctcttcactaccgactggctcccctgtttgttcactcactgtattcgcaacttttgtaatggcaactgtcgtctcaagttctttcatactagctacaaagtcctctttatcttctacgtcacacactacttcttcataaaattccatacattttccctcatttcagctgctacaattgcaaaatatggctcattaatttcaaaaaatctcatttttcatcttcctttctagttgtgtatttctgtcgttactaaattttcatatctacaaacatttatagtatttatttattttgtttgtttattatggtactttatttaaaaggagtgattctatggcgaacaatattgaatttgaagttgaaaaagtttataaaggcagaaccaacgaaatctttgttattactgatcccgagacacaggtacaatatattcaaacaattgttatcggttctgacggaaaaggcgtcgcaattacaccaagactagagccagatggaagtattcattataaggattaattagatcaacttgtgttggtcttttttctttccaagttggtaatttcttccaattgctgactaacgaccgctaacgaatttcctcagactatgcagacctctgccacgtcttttcgatttccgatcaatccaagtaccagttgttccccaataatcaatcatgccttttggcgtattgatcgcaaattgatgattattggataatgggtaaactcaaaacccaaagacttgatattttttatcgctgaatcgcccatgcgcttaacatgctgctttctacgctctttcaggtaaggcttcgcatctttccagtattcagccatttctcccataaaataccttctttcttccgattacaaaccccttatttagccaaaatcatatttttcagcttaacaacagtttgatcaccaagaactttctgccgccactcgtcctgttctttgtgacagacaataattctcacatgtgccgatttctcataaattttcagacattccgctctaaccaattccgaaaatccttcgatggcacagttgtagatcttgccgacttttactttcgtttttgctggtctgaccttcggttgaatctcgaagcgacgtccttctggatgaataacaaaagagtcttgtaatctcatgatttttcctcataaaacttactttcgataaatagtccagtttttcggtcatatttagccaaaatcaattcgatttggtacctaaaacaaaatagtttagcttttattttaaaagcctcagtttgaactcctttaacatcaaccgcttggaccaatttgtttccatcccaaaatgtgaagtccggagtataagtgattgaacgtatggttttattccctaagcgaaatttgggttgaagctcgaatttttcttgtaatcgaagttcaataccattggtttccgcatatttagcagcgaatggaaggtatcgtgcttcagcaacactatcgaatttaatgccattgacaacagtttttcgattgctgtattttggtttcttggatagtttagttgctctcataccgccacaccctctcttgccatcagtcctcgatatagcaacttggcttcttgccacattgattcagtggttccggcagtgagaaactcgccatagtgcgtcttcgatacttttcccaagctgattcgagtgtgacgatacattaccatgaagattcgaaagcggacctcttctggctgatcgctgtcgaggattcgcttaacattttccatcaagttcttgtgactagagtctaatgcagcgtagatttgcttaattacagtgattcggtttaattgatcaatttccaaatggatcatcccccgcttcttttcgtagtcgttccatgatctcagcttccttttgagcgttgtattcttctggatcattaagccattcaggtataggttctgtgcgaattggcttcttagaatagctattttggttcttgtgccttacatcatctgctctaacatccgccatagttttgatatttttctttacccagctttgcataattcctttggcatatccgtatgacttctggtctatagcagaccgtctcatagcctcacaaaccatttcttcgccaatatcctcaacccaatgacgtagatcatcagcaactaatccgttaatcactccaaagacttcttgatagagctggaaaggattagcagcagccggagcgctctgcgcattctctgctgttgctggtgatgttgttggtgttgttgctggtgatgatgctggttgcgttatcgtatcgataccatatccataccctatcgatacggtattttcttttggtttcaaagtttggatagggtatttatattcttgacacttcttgatgacctcaatctcaaattcaagtgtttttatctcctttaattctttgtcgatgaccgctgcgactttaggagatctggcgctgttgtatttgagccagttgactatcatcaactcttccgacttttcattaaagacgattcggccttcgctaacgaggaagtcaatgtttgtttttatttcttctgcagtcatatctagttcaaacttcgcatatctcagattgaattcataaacaccacattgagttgtgtaatcattcgataagagatataggaaaaaaagtttttgatctttgctccattcaccgactcgtttgtctttccaaaaagtggtatggagttgtctataaatagccattctttaagcgactcctccttattccaataaatcgcctacttctaaaaatcctgttaaagacttatgttggcgacagtattcacatttcccgcacattttcggcgcttcttctccatttttcactcgtaagatatgaggtaattcttgttccaataatcgaagttcaaaatcaaagcgtccaggataaatactgataccagcaatatcaggaggcgactcttttgttactgcaaagatataaggtgtaatttccctgttataggtttgttcgagtaagtttttataaacagccatttgtagaatatagccatattgctcaacaaacgaaacgtagccactatatttttgtgaccagtatctctgagaaagactccgagtcgtttttaaatcaacaagataacctttctctaaattgaaacaatcaattctggctttccattccgtatcaaatagcgttcctgttagaatcagttctttctcgccttgatagacaaaacgaaaaaatcatcatattctaaggtttcaatcatattgatcgcctgagcaaactctgcccgttctgatccattctttttataaatagcacttgcattctcttgtataaattcttgatgtgcctcaggagacttaaaataagaatggacatagtttccaactagtaaagccgtaggatcactctctggcgaccattcttcttttaattttgccaaagtcgctgcttcgcattcttgaaatgttttgaattggctgactgacatatactgccagtcagcttcattgctataatagttcttcttgtttaagtccatcggtatccgtcaccttcgcttctttcaaaggatctttctttgtttgagaaaattcttgttctagtttcgacgattctttcttttcggcggtcggaacctcaaaccaatcttctactttactcatgccatgagtgttgctgattactttgattattggtttgaaaactacgttgaaaaaagctaaaatacaatactcagaaaaattatctaaacatcattaataaatacattaaaccagaaataggcaagtattacttgagctctatcggcccctctcgtcttcaagatttaatgaacaagttacccaatggatttgaccgccctcttgctaaacattccgtagaaattgtacttactgttttaaaaggagcatttaaaagagctgtctatccatggcaagcaatcaattcaaatcctatggtatacgttgaaatgccagccttcgaaaataaacccaaacaaacaagggatgacatgaaaattatcactatggatcagtatcaaaaaatacttgaatttaatcccccatccagtcctttcagattaccactcatgattggctttcatacaggattgcggagaggtgaagtatgtggtctacagtggtcagatatttctttggatgagcgaacaataacagtagatcgaataatgttacaggacaagcatggaattcagcttggcactcccaaaacacaagcaagtttcagaacaatagcaattgatgatgtattagcagctgaattaagaagagcaagaaagagtcaatcagagaataaacttaggtatggtaaattctattacgattcaacttttgtctgtacaaaagacaatggcgaaccagtgacaccaaattctattaaatggcactcttctcgaataaaaaaggaactcggaattgattttaattttcactctcttcgacatactcacgctaccatgcttttagaagatggagtcaagccaaaaattgttcaagaaagattgggccattcaaggattgctactaaaatggacaaatatgtccatgtaactagaaagatgaaaacagaagccgttgatatattcgcccaacgattgaaaaaatccgctgaaagataaaaaaattgtcacccatttaaatttatgggcgacaatcgggcgaatgtttttgaaaattcacaaagaaacaacaattgttttcaagaaccccttgctatttcttcggttcatcctcatccattttcagaacggccatgaaggcttcctgtggaacttctactgaaccgatttgtttcatgcgtttcttaccttctttttgtttctctaggagtttccgtttacgagaaacatccccaccataacatttcgctaaaacatttttgcgcagagccttgatatcggagcgagccacgattttttggccaatcgctgcttgtatcggtacttcgaattgttgacgcgggatgagttttttcaatttttctacgatggcttttccgcgttcgtaggcaaaatctcggtgaacaataaagcttaatgcatcgactttttcagcgttcaacaagatatccattttaactaacttgctggtacggtaaccggacatttcataatccagtgatgcataaccttttgtgctggatttcagtttgtcaaagaaatcaaagacgatttcagataatggaatttcatagacgacattgacccgataatcatctaggtagtccatggtgacaaaatctccccgcttacgctgtgagagttccataaccgcacctacatagtcatttggtaccatgatttgtgctttgacaaaaggttcttcgacattttcaatagtacctggttcagggaaatctgctggattatcgactgtcacggttgttccgtctgtcttgttgacatgatagataacagaaggcgctgtcgtgatcaattccaaattgaactcacgttctaaacgctcttgaacaacatccatatgcaagagacctaggaaaccacaacggaaaccaaagcctagcgcttgagaagtttcaggctcgaattggagtgccgcatcattcaattgcagcttctctaatgcttcccgcagatcattgtaacgagaagtatcgattggatagagtccacaatacaccattggattcatttgacgatacccttccaaagcttcttgggctggattatttgctagtgtcacagtatcccctacttgtgtatctttcactgttttgatagctgctgtgatataaccaacatctcccaccatcaatgcatcccgttggatcgctttaggtgaaaataccccaacttcggtgacatcaaaggtttttccattactcatcatttgaattttatccccaggtttgaccatcccatccatgatacggacgttcagaacaacccctcgataagaatcgtagacagaatcaaagatcaatgctttcaatggcgcttcaatatctccagctggtgccggtacatattcgacaatttgttctaagatatcttcgatgccaattccggctttggcactagctaaaaccgcttcacttgcatcgataccgataacgtcttcgatttctgtacgtactcgttctgggtctgctgctggcagatcgattttattgatgactggtaagatctctaagtcgttgtccagagccaaataaacattggctaatgtttgagcttcaatcccttgagctgcatccacaaccaatacagcaccttcacacgcagccaaactccgcgatacttcataagtgaaatccacgtgtcctggtgtgtcgatcaaatggaaaatataggtttcaccatcttttgcggtataattcaactcaaccgcattcaatttaatggtgattccccgttcccgttctaagtccatggagtctaataattgattttgcatttctctggacgttaccgtatgagtttgttccaaaatccgatcggctagcgtagactttccgtggtcaatatgagcgataatggaaaagttacgaatcttttcctgtcgttttttcatttcttctatattcatggatacgttcctcatttcttttagtcagcttttctattataccaacgaaatgctgataattaaagtatttttcttgaccgatatctaaacaaatttgttcaggttttgctatactatagctagtaaataaattggagttgaaagaatggacaataattttcatcaagatttgcatattcgaccagtagaagaaaaagatgtcgatcagttcaatgagcttctaagctatgtttttcaaatcactgagtcggacatcgaggaaagcggttatgaaagcaagcgtgaaatgatcaaatcaaaacgaccaatcttggaattatctaaagtgttcgggtggttcaacggtgatcagcttgtttcacaaattgctgtctatccctgtgaagtgaacattcatggaactctttacaaaatgggcggcgtgaccggtgtcggaacttaccctgaatatgcgggacatggactgatgaaagacttgatcaaactcgctcttgaaacgatgcgagcagatcagcaatggatctcttatctctatccttataatgttccttattatcgtcgtaagggctgggagatgatgtcagataaattaaccttcaaaatacgtgatacccagttaccaaaaacggtggaagttccagggatcgttgaacgaaaagaggtagatgatcctgacgttttcactgtctataatcaattctcaagagaaaatcatggcgcattacagcggaccgctttccactgggaagaatactggcgctacgaaaacgaagaaagccgaacagcagctgtctattataataaaagtggtcaccccactggtgtgcttttttattgggtcgccgaagaagtctttcacgtaaaagaaatgttttacttgaatcaagaagcccgcaatggattatggaactttatctcggctcatttctctatggtctactgggtcaaaggcgatatctataaaaatgaacctttggctttcttgttggaagacagccaaatcaaagaaacgatcgaaccttactatatggcacgcatcgttgacgtaacagagtttttgaaaaaattcccctttaaagcattcgatcagccttttcatttcgttgtctccgatcctgttgctgaatggaataatggtatttttggattgaactatgctaaaggtgaagtcatcgtttcgaatgatccgatcggaaaagcggtccaattagatatccaaacgttaacttgcgtactgatgaattatcgaagacctgcgtatttggctcgaatcgagcgtctccataccgattcggatacgttacagttattggagactattattcctgatatggaagcttattttggcgactatttttaatcatgttgataaaatgaaggagaatgaaaatgaatatttactttgcagcccccctctttgctaaaagtgatctgctttataatgccgatctagtcaatcaaatccgaagcacctatccacaagcagatatctatttgccacaagaaaatgcatccattaatgataagtctgcttatgctgatagtaaaatgatagctcaagctgatacagaaaaagttttggaaagtgacctaatgattgcattattagatggtctaacgatcgatccaggcgtagcttcagaaatcggcgtggcttttgccaaagaaatccctgtcttagggttatatacagacagtcgccaacaaggagcagataatcagcaaaagattactgcactgaaaactgtagccgaaaatcaatttcattatttgaatctctatacagtcggtttgatcaaactgaatggagagatctattcttcagaaaacgctttactagaaggcttggctgcctatctcggggaggaacaataaatgggtgagaattataaacgtttattaaaactatttacactatttggcttccttgttttcgcattttctgtttgggaattctttcgaggtgtctatcctaaacagcaagcactgatttttctagttcaagcattactaggtattttgttgatctatgtacctgaattcagtaaaaagctgttccgtattcaactgcccaatgcgactatttacttttattggttctttctgttgatctcggtctttatgggaacgattttgcatctgattgaaattatttccttctgggataaagtactgcacacagttagtccgatggttctgacagcagttggttatgggctgatctgtatgttcctaaaagatgttccagtacgagaagtttctccatggctttttcttctgatgggatttgcttttgcaggcctgtgtggtgttttttgggagttctgggagtttatctgcgattcgcttggtggaatgaatctgcagcgctatgcgacgctagaaggcaccccattcattggccgcgaggcattgatggatacgatgggtgatcttttgaccaacacgatcggagctgtattgatgggattgattgcttacttccaagggcgaggcaagcctgattattttgaaagctatcgtatcaaaaaaattgaacagtgatttttatcaactgtctgaactaataaaattagttcagacagtttttttatccgaatgatttcgcaaaaactaattttgacaatgatctttttttagcaaaaatctcccaaattcattgaacccgctttcattaataaaggaataaacgttatttaataatttatgttattggacgagtcctctttataccaataattgcaaaaagaattgcctgaaatgcagtgtatttgatttcacgattttcaaaaggtctgttataatatttaacaataagtcgacctggaagtcagtaaggagatcgccatgattttgacggtattttttcttttgtgctgcatgatcttttcatctattacctatgccttttctaaagatgcacgaaaattcgtccaacccctgcctattaaaatcattttcattgcttctgcggcgattgccgtttggacaatgttcttttccgtgattgcgctagtagcttgggtcgtttaaaaaagcattcttgcatgtttcgagtgaagactcgctcctgtgcaagaatgcttttttactgtgcttttaaaataatgaaatttcacttaatggccagtaacgcaagataacttttccttgcatttgatcggcatccaccacaccgaaagaacggctatctcttgaaatcagacgattgtctcccataacaaaatattttcccttagggacggtaatagagaaatcttcagtgaattgggttgcactggccgcgatttgctggaataattcccggtagctatattccttttgcaactgatcatccgcaaattgcttcttaaaatcttctaagtactcttcgtgatactctttgccattgattgtcaggacgtcatttttcatctcgattttatctccaggcaaaccaattaggcgtttcaccgcaattttactggtatcatccggttctacgcaaataatcacgtcttgccgctgataacttgaaatcttggaagcaatcaagcgttgcccatcagacaaagtcggatccattgaatgcccgctgactttgacaggcgttaaaataaacaatcgaacgacaacaatcaccacaataaaagcgagaataaaccaattctcttttaaaaatttctgcatcttattttatttgctccttcaactattttctcagtagatccttcattagaaaatagacctgcgttttgcgtttacttctcaatcttacgtttaatttgccttttcggcaagtaaaatctttttacgaaagtttttttttaggagaaatttaccaatctttgtttaataaaaaggaagttcttaaaccacattgacgtagcataataacatgatgatttttttattcaaaagaaaaaacctgaaaaatagcggaataggcagaagactttattcaggtctttcccacagtatcattccgtctatcattcaggtaattcaagggttatttttctcgtttaagttagatgactaagaaatctcttattcacttatcggtgtattttcaaaaacaagctggtcattcaacacttctatcgtcacttttgttttcggcagaacacgtcctgcaacgatttctttagccagaggtgtttctacctcccgtgtaatgaaacgtcgcaatggtcttgcgccataagcgggttcgtacgaatgctctgcgatccattttttggcttcttctgtaatggataattgaatgtcttgattttccaatcgttgagacaattgagcaataattttatccacgatacctgtaacattggctaggcttagtggcgtgaacaaaattgtatcatcgatacggttcaagaactctggtttaaaatgaccgcgtaatagcgaacgaacattttcagccaccgattctggaatcgttccttccccagtcacaccatctaatagtatttgcgagccaatattgctcgtcatgatcaagaccgtgttcttgaaatctaccactcgaccttttgaatccgtcaatcggccgtcatccaatacttgcaataaaatattgaaaacatctggatgggctttttcgatctcatccaataagacgatcgtataagggttacggcgaacagcttctgtcagttggccaccttcttcaaaaccaacataacctggaggtgctccgactaaacgtgacacagaatgtttctccatgtactcactcatgtcaatccgcaccatatgatcttctgaatcaaacagattgacggctaacgctttggctaactcggtcttaccgactcctgttggtcctaagaataggaaagaacctaatggtcgatttggatcttggagacctgcacgggaacggatcaccgcatcacttactgcatcgactgcctcgtcttggccaatcacgcgttgatggagtgtttcattcaatttcagtagtttttcccgttcgccttctaccaatttcgcaaccggaatgcctgttaggcgaccaacaactagtgcaatttcgttttcagtcacagattcttgcaccattcgaacgccttccgcttggttttttgcttccaattcggcaagttctttttctaattgcggaatcgttccatggcgtaaaacagcagcgcgctctaaatcataattattttcagcatcttctaattcatgtttggctttgtcgatttctgcccgtttattggaaaccgcattgacttcatctttctcagtttcccattgcatcttcatggtattggcttcttcccgcaaatcagctaattcttcttgcaggtttgccaaccgttttttagaagcatcatccgtttcttttttcaatgcggcttcttcaatttccagctgcattaaacgtcgcgtgacttgatcgagttcagttggcattgaattcatttctacgcggatcgttgcactcgcttcatcaatcagatcgattgctttatccggtaaaaagcgatctgtgatataacgatcggataatgtcgctgcagcaactagtgcattgtcatgaatgttgaccccgtgatggatctcaaagcgttcttttagtccccgcaagatcgagatggtatcttcaaccgttggttccttgactaaaactttttggaaacgacgttccaaagctttatctttttccatatattgacggtattcgtccaatgttgttgcaccgatcgtatgaagttcaccacgagccagcattggttttagtaaattaccagcatccatgctgccttccgttttgccggcacccacgatattgtggatctcatcaataaataagatgatccgtccttcagatttcttgacttctttcaagaccgccttcaaccgttcttcaaattcaccacggaattttgctccagcgatcaatgcgcccatgtctaaagagaaaatcgttttgtcttttaagttttccggtacatcttttctaacgattcgttgcgccagtccttcaacgatcgctgttttaccgacaccaggctctccaatcaaaacaggattatttttggtttttcttgaaagaatacggatcacatcgcggatctcttcatcccggccaatgatcggatccatttttccactgcggacttgttgaacgaggtccacaccatatttttctaaggctttgtattgttcttcttggttttgagatgtcacacgttctccccctctcaaagattcaatggttgcttttaattctttttcattgattccttgaccttttaagtaattggtcaatggatggttttttagtttcattaatgcgagtaaaacgacttcagtcgataaatactcatcattgaaccctttttttagttggtctgcttcagaaagcaaacgaaataagttttgactcatgctttgtccgtattgaacattgccaccttcaacagatgggatttcatccaatagtcggtcaacttccttctcgaaagcatcgacatcaagaccagcgtccgtataaaaattgcggccaaattgattggcttgcaataaaattttccataaatgagcgatatctatctcctgatgatggcgtgttatcgctacttgttgtgcttctgcaatggcactttgtaaagttgttgtcattttttctgggttcattgttctacctccccgtcatttctaggatttctcctacattgtagtataccattttggtcagtaatggtcaaaagatatgcaagcactttttgactttcttttttagcaaactatcagcaaaagttgacataaggaaagctaagatggtatgcttaatgaaccatttcaacggaggaaaagcagatgtcacgctactattttaaatttatctttaaatttatcagaaaatctgctcttaacaagaacacgatgaagcattgttaagagcctacaagcgcctagcgcatctgcttcatcaaagactcggagtgaggtttctttctcatgccctggtttttggtggatactaaaaagattgtaagctgtagacaatgactgtctatggcttttttatatggaggaagatcatgttaacactatcaaatctatcgcaacaattcggcgacaaaatcttgtatgaagaagtcagcgttcaaatcaatcgtggcgagaaagtcggactgattggacgaaacggtgccggaaaaagtaccttgatcaaaatcattaccggggagattcttcctgatgaaggccaggtcactttcccaaaaaatctgaaaatgggctatttggatcaatatgtcaatgtggacgaaacccaaaccattcgcgatttcttacgctcagcctttgctgctgattttgaaaaagaggcaaaaattgcttcactatatggtgaatatgctgaaacattggatgatgagttacttgaaaaagccggtgaattacaaaatcaattggatcaaggttccttctatcaaatggacacactgattgctgacttagcggaaggtctgggcattgccattcttggtatggaaaccccactggtcaatttaagtggtggtcagcgatcaaaattaatcttagcaaaaatgttattggaaaaacccgatatgctgatcttggatgaaccaaccaatcacttagatgatgagcacatcaagtggctggttcaatttctccaagatttcaatggcacctatttggtggtttctcatgaccaacagtttctcaaccagatcacgacgcatatcattgatattgaatttggcaaattaacgaaatataccggcaatcttgaaaaatcactgaaactcaaagcgttgcaaaatgaaagttatttgaaacaatatgaagcccaacaggcacatatcaagaaaacggaagcctatattcgaaaatataaagcgggctctcgttctacgatggctaaaagccgagaaaaacaattagcgaaaatcgaacgattaacgccaccaacagatgcgccgacaccgcatattgcttttccttatgcccctatcgtcacaacattggcgttggaaacaacacacttagaaattggctatgacaaaccgcttttgtcaccgatcgatttgacgatacgctacggtgaaaaaatcgctattcgcgggtttaatggaattgggaaatcaacgttgatcaagacactcttaggtcagataccggctatcaatggatcggtttcatttccccaacacacaaaattcaattatttctcgcaagacttaacttgggaacaaccattacaaaatcctttgcactatatgagcgataaatttcctaaagctataatcaaagaactacgccgccaattatcccgtgcaggattgccgagtcagctggcacaagaagcgctaaaatcattgagtggtggcgaacaaacaaaagtcaaacttgccgaaatgatgatgatcaaaagcaattttcttctattggatgagcctactaatcatattgaccaagcaaccaaagataatctgaatgcagcactggctgattttcaaggaactgtcttagtggtttcccacgaagccgatttctacgaagactttgcagatcgaattattgaattaagtgaataagtacgacactaaaaaatctcgaagaagtgccgaaatttcagcgaactagctgaagtttttgaggcatgccttcgagatttttttgatttagatttaataggagaaagaaaaagtttcattcctttgctcacgctttttcgttcttcaactcttccaactcagcactcatggttttgcgtttttccaaaatgacatagacgaaaccgatcacgaatggccaaataaaagtagcaaatcgataaagcaacatcgatgacgctgcatcaacagtccctaccattggtccaaaaagtaacatataaacaaattcaaacgaaccgattccagccggcgtaggaataacacccgataggatcactgcaaagctgacaaaagaaagcgtcagtaagaagtcgatttctggatgtttaggtgccaatactacataaggaatcacataccaagcagccaatttaacgacattccagaaatagatccgtaaaaaagccgtacgatcacggagaatcgaatagactgtctcccgtaacgagtaaatctgcgtattgcaagtatcgatgattttgcgcatgctcttacttttgaaaagtttgtcgctgattaccacaaaagcgacttgaacgttgacacttacagaaagtgcaagtaaaaaggcaataatcagaaaagtaacgaccataccagctaatatcacccaaatcatatttggggctttctcaaagaataaagaaaattgaatcactagccctgcgatagcataagtcaagaccgccaatttatacatgaccatatgcaacgtagtcacacctacaccttgtgacaatttcaatccatttttacgataaaaattgacttctgatatcaacgtcccagcaccaaaagtaataattcgatagaatccagagtaacaaacggtaaataagccgtctttcgttgtaaactccggttgaaatcctacagcgatctctttgacggaacgtccttcaataaataagtaaattgttcctaacgccatcactgctgtaacgatcgacagactggtttgtcttaattccgccaaaatatcagtcatagagctgcgaataaaatagtacatcgcacctaagatcacgaccattaatagcaggtttaaggcaaatttcacttttgctttcatttttaactccttaggcaaacttaataaacaatagaagatctacaatcacaccgaaagcaaaaaaaatataaaatttacgtttgcgtgttttatggtgaaaaacgcgttgcgcgatcaatccaccgattccgccgccaatcaatcccataaacaacagattccattcagggacacgccatttttttcttacggcttggtatttatcataccccatcaagccaaaaagataaagattcgctataagtaaataaaaccacaatggattttgtataaattctgtcatcatttctcctctggttgatattatttagcatccaagtcttcttcttgaacacggacacgaagggcctgtttcatcaccttcattttaacaggcagattatctgtcggatcgccatcagttcgtgtataaacagttttttcctgagcacgaatctcaatttcatttgcagtaaagtactcgacacctggcactttcgcaatatgaccacgtatgatccggggcaaataaataatgaattccaatagattgagttttggcaataaaatcatgtgaaacagcccgtcatctggtcgtgccaactcgtcgaaattggtaaatccgccagctgaattggacatgactactgttaacaattgactcttgccacgccagcgttttccgtctgcaataatttctaatttgtattgtttctttttgaataaataatggaaaaaccgcttggtaaaagcgagtggtccgaactgttgtttttcttcttgcgaagtagccgctgccgtatcggccagcaatccgatggtcatcgtcgagatcatcatggagtcattgaccaatccataatcaatttgtcgatcagtcccattcaatatcgtttcaaatgcttcttcaggtttgagaggaatccctaacatacgggcaaagttattgaccgttccgcctggaataattgccactgtcagcttatctaactgatccacaaatgtttgcagcgcatgatggattgtaccgtctccaccaatgattgcaatcgtatcgatttgatgttctttcgcatttttttggattgtttccggctcaatatcaggattggaaggttgcaagactgcttcacttttaggatcatgttcttctagatagttcttaaaagactctgcagtatccttggcatcgcttttaccagccgtatcattatataaaaccatgatcttcatatttttcacttcctaaataaaatagggctgcgaatggtgcagacttctgcatcaagtctcagcccattattcaactcatttttcattatcaagcgatatttttccacttgaaaacgaaacaaaataaagttctactgtgcgtttttttcggcaatcttcacgattacatcagttgcttttttcattgattccaaggaaacaaattcatagcgtccatgcatattttcaccaccggcaaaaatatttggtgtcggaatccctaaataagagatcttcgatccatctgttccgcctcgaactggttcgatcactggctcgatacccagatcttccattgcagacttagctaactcaataatactcatgtctttttcaatgatttctttcatgttgtaatattgatcatataaatccatttggattcttgcttcgtcaaattgggcattcattttttcttggattgtaagcaattgttttttacgattttcaaacgtttcacgatcatgatcacgaatgatatacgccatttttgcttcttcgacggttccgttcaacgccatcaaatggaaaaagccttccgcaccatcggttttttctggcacttgatctgttggcaattgattatgaaaatcaatcgccaattgcaaagcattgatcatcgtatcttttgcggttcctgggtgcacatttttcccttggatcgttagttcagcttgtgcagcattgaaagtttcatattgcaactcacccactggaccgccatccatggtataagcaaaatcaacattgaaatcagccacatcaaatttatcagcccccaccccaatttcttcatctggtccaaaggcgattttgatttctccgtgtttgatttcaggatggttaagcaaaatttccatcgccgtcaaaatctctgcgatacctgctttgtcatcggctcctaaaagcgtgctgccatctgtcgtaatcaatgtttctccacgataatttttcaaattaggaaagtctttgatattcagtgtaaatttgccctctttatccaatttgatcgttgactcaccgtcatagttttcaataatttggggatccacattcaccgcgttaaaatccgccgtatccatatgtgcgataaatccaatggaacgaactggttcggaaacattacttggtaacgtaccaatcacaaaaccattttcctcattataatggacatcatgaagtcctaattcttccatttctttttgcaatgtcttggcaaacgccacttgcgtttgtgtggagggtgttgtttggcttgtcgcatcagaacgagtttccgtctttacatatcttaaaaaacgcggtaataaattttcgtacataattgatcactcctatttatattggaatggatttgtggaagtctctgaaggaataaagtctacctgccaaccttcttccgctttccattcattgaattttttgataaaacgagggatacattcccgttcaatgttatgacctggatcgattgccgtcaagctgtttgcttgtatatcatgagcggtgtgataactgatgtctccagtaatatatacatctgctttggcattcacggcttcttgataaaactgttcgccactgccgccgcatatagcaatccgttgaacgttttgccgctttgcttttggttcgatcaaacgcaacccctctaactgaaaaacacttttgatttcatcgatgaaatcttccaacaaaacaggtgcttttaattgacctactcgcccgatcccataatgctgagacaagttatccaaggaataaaggtcataggcgggttcttcatagggatgcgcctcaaccatcgcttgcaacaccttttcggtgatggtttctgggaaaatcacttcgatttttgcttcttgtaccgactcttcttccccaatttcaccaatcgcaggatgcgcatcctcttgaggagtaaaacggccggtaccaatcagtgagtagctggtgttttgataatttccttgctgtccagctccagcttttcctaaagctttcctcattgatgcgccttgctcaattggaacaaaaacagccaattttttcattttgattgtatgggtgggaacgagatacgtggtttcttctattccaagcatttcacaaaaccagtcattcaacccatcatgaataatatccatattcgtatgcgcagcatagaccgaaatattatgtttgatcagatccatatacattttttgttgcggatcatcggctctcaaacgacgtatggaacgaaaaatcggtggatgtttggcaacaatgaagtctacttgtttttcaattgcttctgcaatgacttctggacgaacatctaatgtcatcattacccgttggatctcgttgtccaacgttccgatatgcaatcccactggatcaccatcttctgctaaccattgcggacaatatctttcgaaacgttcaataaacgttctagctaacattattccagcacctccttgatccaatcaatctgttcgtttaactcacttattttatcttgaggaggaattgccgctttctctagttcttgcaaaacgatttctcgctgctgcaattcatgggcccattttttataaaaaacgagatttttttctttcaataaacacgggccaaaaaataattcttgtggtgtatagattttactgccttcttcagctacgatgatttcgtagtttttatggttttcttcaatcagttcttcgtgtaaaatcatgtaattattctcctgaagccattctcgcaaagtccgctcccccacattgggttgcaagacaaggcgctccttcccagtaattttctgctgagattttccattttctaaaattgttcgaatcaaagtgccacccataccagcaataaccaccgtatcaatctgatcatcaggttggattgcagctaacccatctgctaagcgaacagtgattttgtcgctcaagccattttttttgacttgccgtgaagcagattcgaatggtccttttacaacttcacctgctactgcatactgaattttattttgtagcatcaatgccacgggtaaataggcatgatctgatccaatatctgccaagcgggcttgatccggaatctgttcgccaacacgagtcaatcgcagggataatgattgttcgttcataacgtcactccttcagaaatagtatatcattctttattgcattttaaagggagagtttttactccttttatttacggctttacttcacctagagttgcttttgcacttttcgtaaagaaaacttgcatatcttgcttttcaaaccaatcgttgtgatccatatgaaggttactgcgctcccgtcacccagttgagtatcaatcgcagtgattcatacgaaggttactactctcccttcggtcgtctagtactgctcatcatctgctctgtcttgcttcgcaagccaatcgcagtgattcatacgaaggttattactctcccttcggtcgcctagtactgctcatcatctgctctgtcttgcttcgcaagccaatcgcagtgattcatacgaaggttactactctcccttcggtcgtctagtactgctcatcatctgctctgtcttgcttcgcaagccaatcgcagtgattcatacgaaggttactactctcccttcggtcgtctagtactgctcatcatctgctctgtcttgcttcgcaagccaatcgcagtgattcgcagcaaaacgcgttgtccgttgggacaacgcgtggggttattgcacgatttcaactgttttgattgaatttcctggaacttgaggtgggattgacatagtcattactggcaagcctgacaatgtgacttggaccgttgttcctttggtcaactcagaaacttgaccttcaaatgattcttgcggtgcgtgtaggatcacgccgtctgtttgaaagttaggaacaatcgtttcttgatcgtcgactgcttcgatatcatttagaaaaatctgtatcgtttcgttgtcgccagctgttgcattttcttgaagaactcctgtaaaaatagtcgttgcctcgctttcgacagtgctatttgttgtgctttcatcgtttttagttgtttcactcatcgaatcattatctgacggcgaaccgcaggaagctaataataaggttgtcaaagccaaacctaaaatcgtcaatttcttcataagaagttctcctctcttctatatttccgaattccggcgatttttgccagtcatttggatctcttttgtcaagtaacgaattcgttccatgatccgcttggctttcaatggctctgattctccacgttgagtaacggatagatgcttctctaactcttgcatggaaaagttggaggaaaagaacgttggcagttgttcttgcatccgatattgcagaatgacaccaaagacttcatcacggatccagctgctcatggcatctgcaccaatatcatccatcattaggatgggggcttttttaactgcattgagtttgtcgccaaccaagtctttgccgattgcttgtttcatttcgacagcaaatgtcgggaagtgaacaagggtcgtcgtataacctgcttccgcaaggtcccgggcaattgcccctagtaaataagttttgccgatcccaaaactacccaccagatataatcctttgtgaaaagcccttggatcgttttttaggttttcaataaactcgactgcagccatcaaagcttcgccccggccgggagtactttcatactgagcaaaattggcctcttgaatatctttcggcatatccattgctttgatgcgactacggatctcttcttgtcgttgatgcgctaaaagctcttgcgtgggcacataagtgacatcgataaaatgaaagttcaacgctagtcgtggctcatatccaggtgcaatcatcgtagggtcattcaaacgaaactttcgtttttcttgaacaaattcatagagtttcgcataacttttttggatatctgcatctgtcagttcctcccgatgttctgaaatgaattctttgacatccggatctttcaatacgtcccccatcatttctgagaaacgatcgcgatagtttcgtttgtctaaaatttttgatagattcttcccaacatcttccattaattgtcacctgctttcttttgcaagtaggcttgcagttttttgtcgatctctgcctgacgttctggggataatgtcgtttcttcaactggtttttcggcccagcttggcagtttttcttcacgaatgatctttttagacgggctttgcggccgtgtgcgtttttcttttgcttctttaactaagtcccgtacatgcttgatcgcttcttccgcggtttttacttgcaattcagaccattgtgccgcaatgttattgacataacttgctggcaaagccgcattgttctgtaccactaacacataatgaataagaacattgatcacactattggataatggcgagcgttccactaagctttttagcagccattgttcggagtctgtgacaaagctctttttttcagctttgattgctttcaagaatgccatcggcgcattattctcactttcgcggatcaatgctagatcgttatcactatacccattttgttttaatgtattaaatcgtcggatctcttcatctgaagtgggatccactttattttcagttttggtaaaacgcgtccgtgctttttgtaaaatcaattgttctaatgccttctgatcgattttcccagtagttaaagaaaccgaatctgtcatcagatccaacagctccatcacatcatagccgtataatgaatgatataggagtagtttttgccgaaaatctttatcgaaattgtctgcacggatgtagcgacgttgagcttcataaagaagaaaatcccaatctagttgttgttcatctaacaccagtctgctttgagtgtcttggaatttgccattgacttcctgtaattcctcttcattggctgcaaattgttgtgtatccaagcgataagcatccataaaagaagccgtaacttcttgatagccttctgcttgccattttgctggttggaacaacgaaacaagttgtcgaaactttcgctctccaacatggttaagcaataagaaactatagagttcatcttgaaagaaatcgctcgcatgaactggctcttgcaggtgatacaaaaatgtgattcccaactcgtcatcttctttttcaaacgttttgagtaagccgattccttctaacttatttcgtgcttgaataaaacgctgtaaccctacattcatcgcattcaaaatatctagatgaataaactcactttcttgcggatcctgctgatccgcagtcagtgtcagatagagtgctaaggcatcactttcgatgattggctgataaagatgaatcagcgcatccttcccttcagttgttagtggacgacttttgaagacacgatacaattgatttggtaatatgttgcccaccattcagggacctcctattcctcttgattgtctgctgtttcttgcggatcacttggttcttttgccttttcaacgatatcctgcaattcttttaagaagactgacatatctttgaattggcggtagacactagcaaaccgaatgtaagcaatctcatctaagtcgactagatcttccatgacatattcgccaatcatcgttgtcgaaacttcattttcacctagtgctcgcacacgattctccacatgatcaacaattttttccatttgttccattgtaacgggtcttttttcagcagagcgtatcaaccctcttaatatcttttcacgattaaattcttcacgagcgccatttttcttaataactaataatggtgcttcttcaattcgttcaaatgtggtaaatcgataaccacagttttcacattcgcggcggcggcgaatcacgcgaccatcgtcggcttggcggctatcaatcactcgagaattgttatgatgacattttggacattgcatagttccaccccgttctctcttccgtgtctcgaatgatagcgagacagcgatgatttatatgcttaattataacatgaaattcttctatctaataggtaaagtctttcaagcgaaagaaatattacaaatttaaataatgtgacggttgtttttttagccacaaaagaaaaacgacagaatcaattctgtcgttctcctccttatctcatttgtaacagtgacacaaactcatccagagtttcccgttgttccatttgttggttgcattgctcactgtcgcgacaaatgtaatttcctcgtttggtgtatgttccatcgccaccactttttgtcaacgataaaaacatggagacagtagactcatgttgacataaaggacagattcctttttttacttctgtagataaatgaccatagattccttggtagcctttttgagtatttacgatcataaatttactttgactgccgatgtcatcccaagccaaatacgtataatcacgaaggtctgtttgggaaaaatcaggtacttttaatttttttactttacgaaacagtttctctgtttgtttgactgaaggcacttgaaaaggtcggacattcttttttagtgcttcaagaatggtcaagctctttgacatcgtcaaagatgaatcaaaaaattgacgaatcagagactgtgcttctttgtcctcctcagaaaaaaatggttgaatggcttcttcagttaacatttcaactgtgcgaatcgtatggcgatcattaacagactgataagtccgaactaattgttggacttgatgtttgatgaaatgaaattgatagggttcaatggtaatcataatagatatcgatcctctctttaatgaaaaagcaaaagatattactgataaattcctctgatcacagtcaaggacaatgcagaattcagcatttgttgaccacctcctggacttcccttttttgtggaaagtcattggctattatagtttttccttcaggggttgtcaatcattgtccgcagacagcattcttttcttgtcaaagtggaattattgataccttttaaaacaggattttcttcttttttatctatttatattgattgacgaatatggtttatcataaaaaaaactccagatcctgtctagagtttttcttcgattcctgtataatgtttcaaatgatcagcatcccgtcgttcggttgaagagatctttgcagcatctgtgtcttcattttcgtttagcaatcggtcccgaccaagtgtttctaatgttttatcacctggttgagcatctaattcatcatgccgatcctcaatttcgtctacctgttgttgacggtgatcttttttggcttttgcttcatttgcctgttcttttccttcttgttccattttttcattattgatccattcaccaattttttcttttgcagaaccaacaattacatctttttcgtctttcaatgatcccatgatgattcctccttttttattagcatagcaagaatttcttcgattgacaaaagatacgtatgcgcttcatttaaagatatggtatactgaatcaaattttcagaatattctttgacaaggagcagtttatggacatcttaaattttgaagacatccagttggttcgcaagcaaactgttttgttgcaagacatcaactggcaaattgctaaaaatcagcattgggcacttttaggattaaatggtgctggcaaaacacttttattacaactgatcattgggatgatctggccgacttctggcaaacggcaagtcctaggtcaagtctacggaaaaacatctgtgccagaccttcagcgcagaattggttggataagtgcgaccttgcaagagaagattcctgctcaggagctctcagaaatggtcgttctatcgggaaaatatgctagtatcggtatatatgaagactaccaaatgaaagacttgaaccaagctattgccattctttgttcaactggcggcagtcaactgattggccagccatttcatcagttatctcaaggggaacgtcaattagtcttaatcagccgcgctttgatggcaaatcccgaattgttgattttagatgaaccttgtaatggattggatctttttgctcgagaagaattgctaagtcgaattggcgagatggtgcacaaggaatcacctacgttgatttatgtgacccaccatacagaagagattttaccgatttttgaccatatcatgatgctgaaaaatggtaaaatccacgcttctggcaagcgccagcaaatttttaacgaaaaaacgttatctgctttttatgggaaacctgtttttttccatgaagtcacttccgatcgcctggcagttttaccaaaaagcaactcactaaacaaaaaatgaaacaaaaaaagagacagctacaaccaaagcctctttccagatatcctttctagcttcagtttccagcaaacgacaaaataatgcgtcaactgttagcttttcagaaataaagggggctcctttgtgccggtgtctctgtcttaattctttcttttagcaagccattcttgtacttgcgtcttaacttcttcaatggttccttgattgtcaaagaggatatctgcccgtttgcgcttctcttctattggcatctgactattgatacgttgttgggcttcgatgctggttaaatggtctcgcttcatcagtcgctgcaactggatcgattccggaagatagacgaccgctacttgatctagcagggattcataaccagtttcgtataacaaaggaatatctacgatcacaagatcagcttttgctttcatgacttcaatctgtcgtaggatttctttacggataaagggtcctaatgagcggttcagcaattcccgtttattgtcatccgcaaaaatgatttttcctaattttttccgagctagtgtcccatcgggattgatgacctctggcccaaaaacagttttgattttttcaagccctggcatccctggctccaccacttcgcgagcaacgatatcagcatcgatgattgggataccagcttcttcaaagcacttgacaacggtactcttgccagtagcaatcccgcccgttacacctacaaccaagctcatctttctgtccccgcgtgtaattgctgacagaatggacaatagtgggtccctcgttgtgcaacttttgtttttacgatcggggtaccacagcggacacaaggattgccggtttgaccataaacgtgtagagagacttggaaatgccccgcttcgcctaacgcattcaaataggtccgaatcgttgtgcctcctgcctccactgctcgggctaagacatcaatgatcgcccgatgcaacaagttaatttcggcttcattcagtgtcgctgccgattgctcgggatgaatctttgcttcccataaagcctcatccacatagatattgcctaaacctgtcacaagcttttgatctaaaagcagcggcttgatggctttttttgatttctttaggtcacgagtaaagtctgtcaacagaaacagttccggcaatggttccggccccaactgcatgattcctttatacgtactgctctggtctttttcaactaaagtcatacgtccaaattttcgcacgtcccgataatgcaattcactgccatcagtgaattgaaaaatcacatgggtgtgtttgtccggcaccccttctttttcaaaaaattcatacttgccttccatgcgtaaatgggaaatcagatcataatcggtcaatttgaaaatcaagaatttgcctcgacgatcaaaagcttgaaattgttgtccttttagcatcgctgcaaaaatcggtacttctggagattcaatgatccggggccaacgaatctccatttctttgatcgttttatttaaaatcagtttctctagtcctctgcgaactgtttccacttctggtaattccggcacaacatttcacctcatttattttgcttcataccacgttttgccccagttactatctgtcaacaatggcacatgcagtgagacagcattttccatgacttctttgacaagagcatctaagcgttctaattcatcttctggtacttcgaagacaagttcatcgtggacttgtaaaagcatcgttgcttgtaatttttcttcctttagacgacgatccaaatcgatcatggcaattttcaaaatatctgcagcactgccttggatcggtgtattgattgctgtacgttccgcgaatgtccgcaaattaaaattgcgggaattgatatctggtaaatagcggcgacgatgatacaatgtttccacatagcctttgtctttcgcttcacggacaacttcttccatataagttttgacccctggatatttttcaaagtaggtatcaatatattgctgcgccgctttgcgagtgattccaagattttgggagagaccataatcagagataccataaacgatcccaaagttgaccgcttttgcttgacgtcgcatgtttggtgtaacttcttctggagtggagatcccaaagactcgcatagcggtacttgaatgaatatcttgtccttctacaaaggccgcttttaaatgctcatcattcgagatatgggctaaaacccgcagctcgatctgagaataatccgaagaataaatgacccaatctttggctcttggaacaaaggcttctcgaattttccgcccttcttctaatcggattgggatattctgcagatttggatcaacggaactcaaacgtccagtttgtgttaaagtctgcacgtaacgggtatggactttgccatctccttgaatcactttaagcagtccttccacataggtggattggattttggcaatttgacgatagatcaaaatgtcttcgacgatcggtgcctgttccttcaactgttccaaaacatccactgccgttgaatagccagtcttagttttcttgatcactggcagccccattttttcaaataaaatcacgcctaattgttttggcgaatttaaattgaactcttcgccagcttcttgataaatcttttgttcgatttcatgcaaacgttctgcaaattcgcccttcatctgatgcaaacgagaagcgtccacgcgaatcccagtgatttccatctctgctaaaatttttgataatggcaattccatatcagtaaagagtgcagtctgatttttctctgctagctctttcgccaaacggacagaaaggtagttgatcgccgcaacttttcgagctaaatgagcgaaaaagacttcttcatctgccggtagtcctcgtttcacacctttgccatagatagcttcgtccgattgaatcgcatcaaatccataatgcttagcaacaccagcaatatcattatttgaatcattggtatctagcaagtaagcagctaataatgtatcaaaaacaatcccttgtggtgcagccgcataacgattcagcgccacatacgttcgttttgcatcatagactttcttctgtgaagaggcattttttagccaagcaataaaatactcattttcaaagagatcatcttgattggtcacataaattttttgctgattcccccaagcgacaccaacgatatcttctaaatgatagttatcgcccagcatctcgatataaagagccatatcctcagtaaacatttccggagtgacctctgttacaacgtcaaaaagaatatcttccatttcttccggttcagtcaccacatttaatttttccaagaaagaattgaagttcatttcttgatagaatggaatcaatttatccagatcttttccttcgtacttcaatgaatcaatggccacatccactggcgcatccacatcgatcgttgccaatttttttgacaaaaaggctgtctctttatcattgagcaagttttctttcatcttgcttggcttcatctcatcgatatgctcgtagattccttcaactgaaccatattctttcaaaagtttgatggccgtcttttcaccgatttttgtgacaccgggaatattgtcagaggcatctccagctaatcctttcatatcaatgatctgtaatggcgctaaaccatcatatttttctgcaacgtgatctggcgtataactttcgatctcgctgacaccctttactgtgatatcaaccttcacatggtcggtagccaattgggtcaaatcgcgatctccagataataccacaacatcaaattgctctttgtcaactttttgtgccaatgtgccgataatatcatccgcttcataattgtccagttcataatactgaacacctaaagcggtgatcaattcgcgaatatagggcatttgttccttgaattctccaggcgtttttgaacggccgcctttatattcctcatacatcgcagtccgaaaagttgttttgcccgcgtcgaaagccaccaggacatgagttggctgttcttttgccattacattttcaaacatggtgtgaaaagcgtaaatcgcattggtatgcaaaccattgttgtttttaaaacgttccaatgaattgtgcagtgcaaaaaaagcccgaaatgcgacactatttccgtcaactagcaataatttattttttgtcatttgaataactcctcacctcaaaagttctctcttattctatcaaagaaatccatgaaaagcgatggattgcctttgttcgattaagccaattgcaaaaaaaaatgcgagtttcctcgcatttcctcattagttgtttttaccaaagattcgcaaaatcgctaagaacaagttgataaagtcaagatacaactgtaatgccatgaagacagccattccagtatttgcttggccattcgttgcttggtatagattacggatctgttggttgtcataggcagtgattcccataaagacaaatactgtcacgatcgacaagaaaaagtcaactggaccactatgcaaaataaacacattcagcaatgtcgaaatgatgatcccgatcaatatgccgtagccgattcgtcccacaacacttaaatcacgttttgtcatgataccaaatgctgacattacgccgaaagtgatcgctgcggaaacaaatgcacctgcgatcgatccgaagtcataatacattaatgtaactgacagcgtcaccccatttaaaagggagtaaaccagatatcctgctatggtcagcgaaggattcttttgcgcttttgcgcctaataccaagaccaaaataatttgaaggatccataaccctgtaaagcctagtggaaaattacggataaaattcattgtttgttctgcaaatacttgtccgaaaaagtaggcagacactgcgctaattcctagtcctacagcaaaaaatagatagactttggaataaaaacgattgagcccttgggcattaactacttcattgttcattttcttcaccttcctctacgatttttggaggttggaccatcactactgcatccaacacacgatcttcttgcgtattgacagcttcaacagagatcgtcactacgtctttcatcttatcgactttgatcacttcgaaatcgaaggtcaacgtctcataatgaaaaacaggttcaataaagttcaccgaaaaattcaccacatgagaacctggtcctggcaaatgtttagaaatcgcacttgtaataatccccatcaacattacagaaggcacgattggccgttggtattctgttttttgggtatagtcatgctgaatataaagcggattggcatcatttgtcaaaccgagatacaacaaaagctgactgtcttcgatcgattctgttaaagataacgaatcgccttcctcgatttcatcaattttcttacctaattttcgcggtttaccaatgttcaaatttatttcctccaaaataaataattttactctgatttcattttatcagatgcagataaaagtgcaagttcgtggtgcgatgtcccaaaaaagcaaaaacggggtgctgacttttgtcaaatcgatgcgagcaatagcaacgaaggctaaatagtaagtctcactggttgattttgtatcatagttctgttgacagccagtgcaaatgagataccatttgtttcgttgatctgctcgggtgatttgatttggtcatcgctccgtattttttataacacgtttcgagtcgtattactcaacaacttttcataggctgattcaaacttttgtacgtccccggcacccatgaaaatgatcacagcatcttgatgatccaataatggtgacacattctcttctttgatcacttgtccacccttttgaatcttgttcccaagatcttcaattttcacatcgccgcgagattcccgagccgagccaaagatatcgcatagataaacgctatcggctagatccaatgcctctgcgaattcgtccatcaatgcaatcgttcgggtaaaggtatggggttggaaaacagcgataatttctttttcagggtatttttggcgtgcgccgtcaattgttgctctgatttctgccggatgatgagcataatcatcaacgattgtcatatcagcgactttcttctcactgaaacgacgtttaacaccaggaaatgacaacatttcttccgcaacttctgtcatatccagcccttctttataggctactgcaatgacccctaaagcgttgttgatattatgttggccaaatgccggtaacacgaaatgaccgatgttttcgttatggatatagacatcgaactcagaacctgtcgttgtacgctgaatgttttttgcttgtacatcatcatcatcattcacaccataataatagatcggtacatctgcttctaattttcttaaataggcatcgtcaccaaacgcaaagattccttttttgacttgcttggccatcgattgaaaagctgagaaaacatcgtcgatcgattgataataatcagggtgatcaaaatcgatattcgtcatgatcgcataatctggagaatacgctaaaaagtgacgacgatattcacaggcttcaaatgagaagaactctgcgttagggtctccatgacctgttccatcgccaatcagaaaactagttggacgaacaccgctcaacacatgggacaatagacctgtcgtactggttttaccatgagaaccagtgactgcaatacttgtgtaaggttgaatgaatttaccaataaaatcatggtaacgcgtaatttctaaccctaattccttcgcacgaaggatttcttcgtgggtatccggaaaggcatttccttggataatcaccatttctggctgaatattctctttatcgaaaggcagtaatgtgattccggctttttccagatcacgctgtgtaaagaagtactcttccacatctgaaccttgtacatgatagcccttttcatgcagaaccaaagccaatgaactcatgccggaacctttgattccaacaaaatgatatactttgtcttgattttccattttttaaaatcctcttttctcaagttcacattacaataaacgcatgtttattaacatttagatttgttgcacgtcctacattatcatacaaaatgaaaaaaatagcaacgagttttgtttttgggcttgactttttgctcaaatcgctatttctttcaagcgtccgcgacactttccacagccataacgtttagtgttcagccttctcgttcgcttgatcacagctccacattgttgacactggtactgatacttcgcatttttcatcatacttggagcataacgaagtccaccagtagctgccaaaagagctttgaattctggatctcggtgtcggtagcctttgccagctaaatgcagatgatagtgacacaactcatgcttgatgatttgaatgaatgtatctacaccaaattcagctaataaatgcggattgaaatctaaatgatgatcgcttaagtgataacgtccaccggtggtctttagccgcccattgaaatacgcctcatgttgaaatggtttgccaaacgattctagagaaactttttcaacgagctgctgcaattctttggtggtcattttccgtgtgttggatcaaccattgtcaagctgattcggcctttcgtggtatcgacttgttcaatccagacagtaacgatatctccgacagcgacaacgtctttcggatgcttgacaaaatttcggcttaattttgataaatgaaccaaaccatcttgtttgacaccaatatcaacaaacgcaccaaagtcaatcacattccggacagttcccatcaattccattcctggtttaaggtcttccatgctcaggacatctttacgcaataatggtgccggcatctcatctcgcatatctcttccaggttgcatcagtgatttcaagatatctgtgatcgtttcttttccgatcgctagttgtttagaaagatcagcaacatttaactgtgcgagtcgttctttggcttctgctgattgggctcctagttgagttagtttaactccagcaacttctaaaatttctttggctgcagtataactttccggatggattctagtgttgtctaaaatattcttcccaccagggatccgcaaaaatccaatcgcttgttcataagctttaggtcctaaacgaggcaccttttttaattggcttctttgcgtgaagctaccgttttcttctctgtaagcaacaatattttgtgcagtcgttttattcaatcctgagacatgctgcagcagttgaggactagcagtattgacatcgacccctacttggttgacggcagtttcgaccacaaaatcaagttggtcactcaatcgtttttgtgaaacatcgtactggtattgaccaacccctacagattgaggatcgattttgaccagttcagctaaaggatcttggagtcggcgcccgatactaatggcgctgcgttcttccacttgcagatccggaaattcttgacgggcgattgggctggcggaatacacggatgcacccgcttcattcacaatcacataaaatacttcatgatcgatttgtttcaattgttcggcaacgaattgttctgattcacgacttgccgtcccattcccaatagcgatcatttggacaccgtatcgattgatcaaacgttgcagtgctggaccagctgcttggcgtttattcatcggtgccggtttatgagggtaaataacttcgatggctaatactttcccagtttcatcaatcacagctaatttacaacctgttcggtaagccgggtcaaaccctaagacgatttttccttttaaaggtggctgcagcaaaagatttcgcaagttttcaccgaagatggcaattgcttgttcatctgctttctctgttaattcattgcggatttcccgctcaatcgatggtgcaatgaatcgtttataagcatcaagataagcctcacgaacaaatggagttgctggtgaattggcgtgcttaatgagttgccgttcaaaataatcagtgatttttgactcatcgacgactaaggcaacctttaaaacatcttctttttcaccgcgattcgttgccaaaatacgatgagaaaccattttattgatggggtgctgaaaatcgtaatacatttcataaacacctttctcatccttttcagtatcgcgaagtgtactcgtgtaacttcccttatttgcaaaataacttctgatccaagaacgatagatcggctcatctccaatggtttcagcaatgatctcgtgggcaccttgtaacgcagattcagggtcagggatggcttcattggtaaattctgccgcttttgcatagacatctcctgttgttggaaatgccgctatccagtcagctaacggctgcaagccattttcttttgcaatagttgctttcgtacgccgtttttgtttgtaaggacgataaagatcttcgacctgctgcatttttgttgcttgctgaatcgattgcgccaattcactagtcaattttccttgttcgtcgatcaaccgagcaacttcttgcttgcgtttttccaaattctccagatattgatagcgctcttcaatttcacgaatttgtacctcatctaaaccgctagtcatttctttgcggtagcgagcgataaacggaacggtgtttccttcatggagcagttccagtactttcgtgatttgtcgttgattgtaagatgtggtttcctgcattagtaagtgcaacacatcatgatttaattctgccatattcgttcacctttcaatttaactgctctaagtttaacataaaaagtttaacataaaaaagacacctcagaaaagagacgtaagtaacaggctaaaaacagaacatacagaacatgaggtgcgaaattaaagctcaaggtataaaccagcaaaaaacacttccgctgaatcatcagcaggaagtgtcatctacattcaaaatctttcttcaacgtcctcgaaagccttagttattaccaagcatggatgtttcctttttactatgcggatccatcttaactaatctgtttggaaatagtttgtataccctatctttttccaaggacctttagacccaatagtcataatgacacatagattcctctatgattagaaaagttttttaaaagtctggatgccaagggccggttaaattttgatattcaatatcttgtacaatgccgtcttcattaaaaatcacgccgtgaacggaaccaccaaaaacagcccctccatcaatgccaatcttattatcatgaaaccataaatccgttgtttccatgtcaccatgaagcatgggtgtgatggtatgtccaaagacgattgtttttcccgtatgattttctccagtatgaaatggctctcggatccagataaaatcgtggtcagaagtatcctgccaatgcttcttggtcaaatcaacaccagcatgaacaaaaagatatttttgccattcataagaaagcggccttgccatcaaaaacgccactaagtcacggtagcgactccggatcattaatgcaatctcagttggcgagtactcttctgttgctcccggatgtaaaagactttccatcgtctccttgcctccattgcggacataagcggaataccagtcttctggtgcgttcaaaaattgcagaaaatattcttcatggttcccgcgcaaataaaccgctcctgtctcttccaccaattgtttacccaacaagagacactctttacttcgtggccctcgatcattcaagtccccaatcagaacaagctgatgcagtgatggatcgtaatccaataaaagttttttaaaaagatcatacatcccgtggatatcactaatgacgtaaatgagttttttcatttgggttcatccccttctttaaattattataaaaaagccagcgaaactttacaactgttagccctttccttataataaaaccaactaaaggagcgagaagatgaattggctgcatcaacaatggatccattttaaaaaagacatgcgagaagcttttgatacaggggctatcgctgcacatggtaagaaatagtttgaattttgattgttaattgattgaatcaaaaaaagagaattctccagttaagtactgggaattctctttttttattttccagaaacagcaaagtaattaccatctggatctgcaaaattaaagaccattcgttcttccatctggatcaggtcgccaacttctacatttgtatctagtaatttcttgtaaagcgttgtgatatcttccgaaaaaaacatgatcgatggtgagttcaatgctacttcaggagaatgggcttcaataaagcctttatcataaagcacaaaacgagcatctgattcgctgcttggtgctatttcaacgatagaagtcccatctgccgtttgctcttcaatgatttcaaatcccaatgattgccaaaacgcaacggatttgggcacgtcctctacatataatatgatctgcatttgattcgcaaacatatctctcactcctctgttgttgatgattctgatgtttctgaggcttcatttgacgtattgaaattcaattgcagacctggtttgtcggtaatgatttctgttacttcataggttaagcgtttgataatatcaaacagcggctccactaagcggtctgtctccgctttgcttaagtcttcacctgaacggacttgccggttcaagatgtgattgacctgccctacccgaccggacagcacatattcaggaaaaacgagttgaaattccaagcgggcgccaataatactattttgtttcatatactcttcatcttgtaccttcaacggggcaaagccaacattcaatttggtttccatttctttgtctttaggcttcatatcgaaatgataagcttcgacgattggttgttgtcgtttgatttccacagtcttcacactccttgattaaaagtatagcataccgatgacatccagcctaccttcattaaaaaaatccagacaaaaagaagcaagatctcttccatgctagaaaacttgttccgtcgttacaattggatcgttaggatacaatcttgacttgataaattgtttttctatctgatggttcttgcttcctgatggattcttgcttctatttcgttaagtaaaattttttatttaagcgttttgagataatctagtgcgtcttgcacatttgagactggtacgatcttcatgtcagtccctagtttcttcgcagctgctaaagcttcttgataatttgttttgatcgaaggatcaacttctttttcttccttcgtgatttcatcctctggtgcaaaaaagatttctacaccactttcacttgcgcttgctacttttttatcgataccaccaatgcggccaacggttccgtcactggaaatcgttccagtaccggcaatattatgccctttacgcaggttttgctgcgtcaattgttcgtagatttctaatgtgaacatcaagcctgctgatggcccaccgatatttcctgcatcaataacaatatcttgatctgaacttatttccgtatggtcaactaacgaaatgccgatgccggcttttttattcgatggcaattcaatcagcgatccggttgcttctttttctacatcatcttggagatacgtcacttggatcttatcaccgactttttgactttgaacataatcaataaaatcttgactgttgtcaaatcgttttccattgacagctactactgtatcaccaacagaaatttttcctttgaagctagagttggactctacacccataacataaacacctttatagttcattgtgtagggaatatctgctagcttcagtgcttgctcaatggcactattttgagaggattccatgtagtaacgttggatccgattgtactcttcatccgttgcaccgccaaaaagttcttcttcagaaaccaagtcttgaaattgattaaatttactgccaattgccgtaaaaacggttgcctgccgaataccgacactggtcaatgaaaacgagccatcgttttgatctttttggtcattgactgtaattagttctttcaaattgatcgttgccccaggctgttcaatataataagggattggtaaaaaggcacaggcggcaactactaatgctgcaacaagtaataaggtatatttaacggttgatttaagattcatgagcatcacgcttctttacgattgcttggtaaatatttggtggtaaataggcttccacatcgccaccgaaatgcaagatttcttttagcaaacttgaactaatataactgtatttggcatttgccaataaaaagactgtttcgagcgtcggatctaagtggtgattcatttccatgatatctcgttcgtactcataatccttgacactccgaattcctcgcagtaaaaattgggcacccatttttttggcagccgtaacggtcaattccgtctcttgcgcaacaacgcgaacattcgggacatgcgctagtgcctcagtgatcaattccactttttcgccaccggtaaagaagttgactttactagtattcacaaagacaccaatgatcaattcatcaaaaagggaagctccccgttcgatcagatctacgtgaccagcagtcaatgggtcgaaactgcccggaaataatgctattctcttcatcttatccctcatttctataaatcgtgactgccgtaatcccataaacctgccgtctactttggaccaatgtgccaatcctctctggcaaatccacttcttttgctgtttcgcaaacaatgaccgcatgagttgccataagatccgcttgtaccatttgttccagctgcaaaaccagctcttgcttcgcataaggaggatccaaaaaaatatagtcgaactgctgttgagtgcccacaaattcttttagggcttgtttggcatccatttttaaaacagtaaacttttcgggctcctttgtgatgccaatattttctcgaataatcttaatcgctggataactgcgatcgacacagatggcatgtgcggcgccgcgagaaacagcttcaatagctaatccgccactgcccgcaaataaatccaataccaagccgccatctaaataaggaccaatcatattaaaaatcgattctttcactttatcggtggttggtcgggtattatccccgcttaagctcttcaattttcttcctcgataatctcctgcaacaacacgcatatgcgttcctccaaaggttccataatttcttaaaaaagtattccagtgaccgtcatctttttgagcaacaaaaatgggtgcgattggcacccaaacttttgttatacattttctgccagtcgaatcgtcgtatttttttcttccacatcaaatccatcatcactcacttgatatgctgcgtcagtgccgattttttccgcaaaattcatctcaacatctggtcgatatgaaggttccacttgccgtacgaaatgaaattgttcgattttattttttttcatttcatagtcttcttcattcaagtacatgaccacatatttcattttgcgtgacacataatggacaaatccgaatctgcgtaaattttttaattggcgtaaactatagacccatacgatcagtccccgtcgtttttggatctcaaacgtttctttcgtctcctcttgcatgacaacttcctccacatgttgattttgattgaaaaaaaggacttccagcgtccactttgacttcctctgagaaacaatcagcaatcgacactgtgatctcatcaagcaagacttgcagctggttttcactgtgtcgaaattctccgacttgaggattcaaatcaagtgcccttttggctttgcgtaatgcccgctgctgttctttatacccgggagcaaacgtgccataagcagctattttttcaaaatcggtctttttatgtacaaatgaatcaattaatcccaatacttcttggtcttggtacatcgccttcttgttgtaacaataagagcgaaacaactgactattcttgatactggaaattaattgttcaatttggtcttcaattgcatataaatggtcattataaatcatctgatgtgctatcctctgtgtgttcattctcatcttcttggattaagactaccatatttgctttagaaaaagcaattcctatcttctcaggggtttgattcgataaaacattgtaaaccgaaggatcactataccatgataaaatcgtaaatgtcggatcgtagacaggtgcttcaaagatggaagaaacggttgaaatttccttttcctttaaaatatcctgccattcttcttgggtcagagtgaaggtgctggttcgttctgctgtcaatgctttttgataggcatgaatccgttgagatgttaaatgatccgaaagattctccgtgatttcttgaaggagatctttggcttcactatgagtatctaaagccatcccaaaactttccagctctttttgatcacgcattttttggatgatcacaaaagctaacgtttctttttcaagagcagctgtttcttggttcactgtttgagactcttgaaacagcggcagctccccttctgttaattgataaggagacagcttcaataatgtcgtttgatccagataagtgactgctgctaattccgatgtcttttgatcaaaaaacaaaaccgcgaaagtgccattgtcaaacgccactaagggacgatagttcatatcttgttccataagttcaaaactcactgaacgatcattttgactcaatgtaaaattcggatagatcatcgtaagctctgtaagatctgtcattgtcatcccaatcgaaaatggggctaaggatgcgccgccttggccaatcactttgattgcctgaacactttcgccgtcggtgttgatttcgagatattgttgatcatctaggtgattgtatacgcgaacttcaaagtcatatcctgtgcgatacgtgcatatcggcgagccaaaatcttcttcaaaatcagaaagaggttcaccgatcgcttttgctaagccatctgctttgattggttcataattcaaattggtaggcgcttttacaggattatcaaaaagaggtcttgaaggagaaacccgctgaaaaaatactggctgcagatagacgacgaccagcgccaaaataaacaagcagcaaaataaaattcctctacgtttcatcttcaagacctacttcctacttctctttgatttcgatcagcaaatcacctgatgtgatggcttctccttctgcaacatagacgtgttctaccacacctgagaaacgagcttcgatcgctgtttccatcttcatcgcttcagttactagaacggtttgtcctttcgctacccgatccccttttttgactaatacttgtagaacagaacctgacatcgttgcaccaatttgttctttatttgttggctcagctttgcgttttgtttgaacggagctgatgatcgaatgatctttgactaagatctcccgacgttgtccattcaagttaaagaacaacgtgcggttgccttcaatatctggttcgccgatttcatccaagcggatgatcaagattttccctttttcaagttcaacattgatcgtttcacctaatcgcatcccattaaagaatgttggtgtatctaggaccttgacgtcggcaaactgttcatatgcttttcggtagtctaaaaagacttgcggatacatcaaatagctcaatacttcttctgttttaggctggtagccgatcttttctgctaattcggctttgactttttcaaaatctactggttcagcaaacgcaccaggacgttctgtgaatgctggccgacctttcagaatgatccgttgtaattcttttggaaaaccgccgactggttgacctagttcaccttggaagaaagtaacgactgattctggaaaacttaaggtttcacctttatcataaatgtcttgttcagataacccgttttgtaccatgaaaagagccatatcgccaaccacttttgatgatggcgtgactttgacgatatcaccgaacatcatattgacttcatgataaacttctttgatttcgtcccatttttccccaagtcccactgcttttgcttgttgttgcaggttcgaatattgaccaccaggcatctcgtgtttatacacttctgtctgaggagcattcaacccattctcgaaaggatggtaatacatacgcacatcttcccagtaatgattcaactgctggatattatcgacattaatttctggacaacgttcgccgttgactaacgcatagtaaaggctactcatacttggctggctagttgctccactgactgcagacatagcaacatcgacaatatcgacacccgctttggttgcggcagagtaagtgatgatgccattgccactcgtgtcgtgggtgtgcagatgaattggtacatcaatactcgctttcagttcactgatcaagcgatacgccgcttgtggtttcagcaatcctgccatatccttgatcgcaatgatatgtgcaccaagattttgcaactccttggccatatccttataataatcgatcgagtatttttgacgagtcggatcattgatatctccggtataacagatcgctgcttctgcaattttgcctgcgtcccttactgcttggatgcttttttccatttgcggaacccagttcaagctatcaaaaattcggaagacatcgattccttgcgcagcagattctttgataaattcttctaacacattatctggataatttgaatatcccaccgcatttgatcctcgaaacagcatttgtaacaatgtgttcggcattttcttacgaaacatacgcagccgttcccatggatcttctgtcaagaaacggtaagcaacatcaaacgttgctccgccccacatttcactggagaatagttgaggaatcccctcttctgtcaacgcagcgatcttcttgaagtcctgggtacgaactcgtgtagccagcaagctttgatgcgcatcacggaaagtcgtatccgttagtaaaacatttttttgctgattgatccaacgaatgacgccatcagcaccttgagtatctaaaatggttttagccgatacgaaatcaggcaatgtctcaatctgttgcggaattcttggatcattataaaatggttttttttgtttctcgattcccggaaagccattgatcgtaatctcaccgatatatttcattgttttatttccgcggtcgcgaatgcgaggaaactcaaacaattcaggagtattatcaataaatgtcgttttcgcttcgccagaacgaaattgcggatgagaaacaacattgcgcataaagagaatattggttttgactccacgaacccgaaattctttcaagcagcgcatcattttttgaatcgcttgatcaaatgtcgctgcatgggtacaaacttttaccagcaatgaatcaaaatagggagttacaacggcgccagcataggcattaccaacatctagccgaacgccaaaaccaccaggtgaacgataagtatcgatttttccagtatcaggcataaagttattggcaggatcttctgtcgttacacgacactggatcgcaaccccttcaaagtggatatccttttgttgcgggattccgatttctttgtgcaagtctttcccttgagcaatcaaaatttgtgtcgttacaatgtccaagttagtgatcatttcagtaatggtatgctctacttgaacccgaggattcacttcgataaagtaaaagttgtctccttctaccaaaaactctacggttcccgcattgatatacccgacatgtttcatcaactgtaccgcagcttgacaaattttttctcgttgggcagcattcattgatacacatggagcgacttccaccactttttggtgtcgacgttggacagaacaatctctttcaaatagatggacaacattgccatgactgtcccctaatatttgcacttcgatatgttttggattactgatgtatttctctacatagacttcatcactaccaaatgccgctttcgcttcgcttttcgctcgttcgtaaccttcacgggcttctttctcatcgtgagcgacccgcatgccgcggccaccaccgcctaaggctgctttgatcatgattggataaccatgggtttcagcaaacagcaaaacgtcatcaatagtgttgacgggtccgtcggaacctggaatggattggataccagcctcgattgcagctgttttggctttgattttatcgccaaagatatccagatggtgtgtcgaaggtccaataaaaatcaagccttcttcttcacagcgttgcgcaaacgctaaattctcggataaaaatccgtaaccgggatgaatcgcttcggcaccggcctttttcgcggtgcgaataatatcttctatgtccagataggcttcaatggggcgcttgccttttccgacaagatacgcttcatccgctttaaaacgatggactgaatattcatcttctgcagcgtagatacccactgttttgatgcccaactctgcacacgcacggaaaactcgaatcgcgatttctccacgattagcgactaatacttttttcatcataccactccattccattgatcaataattcaaactatattgtttcctcttttcttctgcactaatgttcaaaataaagccgatacaaatcgacaacattaacaaacttgatcctccttgactcaaaaaaggaaaagtgatccccgttaacggaatcaagccggtgatcccacctaaattgataaagatctgtgacataaataatgtcccgatcccaatacacatcatggaattaaaggaatctcttgatcgaatgccaatcaaaaacattcttcctaccatataaaagagaattcctaacaaaacgattgagggaatcaagccaagttcttccatcacgattgaaaaaatataatcggtatgggcttcattcaagaagcctcgtttttgaatactatttcctaatccgcgaccaaataatccgccattgaacatggcataatatccattgaccatttgatgtcctgtatcaaattcatcggcaaaaggattggtgaaagcggcaaatcgattgtagatatattcaggcagaaatttcccacctgtcaaattgacaaaagtaatcgccaaaaaactaaagagaactgtggccccacctaatatcagggtatacacatagtttaatccgctagccagcaaaaccacaaaagccagcatgaaaataataacagcgttcccgaaatcgggatagaaggccaaaatcaccgtataagccaatacgatcgccattggtcttctcacagaaccccagaagtcttgctggatgccctcttggcgataagagaatgtgaccgacaagaaccaaatgataataaactttaagtactccgctggctgaacagagaatcctgcaatcgagagccagccccatgcaccattccttttttggaagaaaaaggcggcgatcaaaagaaagaaaataacgatcatggcaatttggacaaacttcttattgcgaaagacatcagttttcatcttgtacatgatcgtgatcataatcaaacttaccacccaaaaaacggcttgattgatcacataagctgctgaagtagtcggtggctttgctgtcattgcgacatatgaggtcgaactgtaaaccatcatcaaaccagttacgcataaaataaggtaaggtattaaaatgctatagtctaaaaggtgtctttttttaactttttctggcaagattatgcctccttgccgatttcagtagatttttgttcttcatatacttcgctatacaattgatttaggtctttttccagatctgccatcaattgttggccagcagcattgtctacaatacccaagcgtgttgcgaaagcgacttgtcgtgataagccatacatttgtgtgtcaacgacttcctcgaatgctttacactgagcaatacacaaactattttcttgattgcgaatcaatcgtttgattcgttcggcatcctctaaaagcagattcaatgccatttctgaatcaatctgcgccattctggtccccccatttcttagtttcattattatagcatattctataccgatttggcacagtaggatgccataaattcaaccgtaaataacgaacataaatttttttttgctaacaaaaaaagcgaattatcgactgatataaaaaaaagaagtattttcattcgtttttttctgtttcattgggttccgctttgctttgtaaatcgtgaaacacgaaccaattgtgaaacattcaaagcgattcacttaataaggaaaaagacaaaagattgatccagcagcctttattgaaaaaaaagaagtggaattgtccacatgttctttcttcctttcaaaaaaagaacaggaagcgcaccgcttcatgttcttttgattactactgtttctgcttttcaccgataaagccatcaccgttaatgtcctcatctgataaccgttcgacttctttgatgaatccctgactaagttcttcgtaagattctccaacaactgcgtcatctggaatttgatctaggttagcaaaaaattcaatatgattatgcaagttggtaaagatcatcggggcatcgccgccgtattcaccatctaaattgatcatcaaacgatcttttgcatctggcgcatcgacttctaaacgagacgtttttgtatagatcaagcgtcggtcattgatatgtttgccaccgttcatcatcaatgcaatcagatgaacgatctcaaaaatatttgccgttttcactatgatcagcgaaaatttcccatcgtcaagtttcgcatccggggcgatttgttcaaaacctcccactgaattcgtcaatcctaggaagaacatcgaagcgccgccaatatattctccatcgtcatatttaaagtgcatcttgattggtttgactcgcggcaacaattctgcgccttttgcaagatatgccaaataaccgaacacactcttcaactctgaaggaacatcataggtcaactcagtcaggtgtccacctgcagcgatattgataaaataatcccgatcagtttttccaatatccattttgatcgtttgttccttgagaatgacttctgcagcagccttcacatcgtttctaggaatcttcaatgcacgagcataatcattggttgttccgcctgggatgatcgccattttggggcgcttttttagcggagcgataccattaactacctcattaatggttccgtcgcctccggctgcaacaaccagatcaaatccggctctccctgccctactcgcttcatcgcgagcagagaatgggagagcagtcgtcgcaaaagcactggcttcataaccggctttctctaagacttctaatatatcggcaagatgtttacgaatcagttcttttcctgatgttggattataaatgactctggctcttttcatattccgcctcttatcgttttgctaattcttcttgaagtaatttgttcacaacgccagggttcgcttgtcctttagttgctttcatgatttgaccaactaagaacccaactgcccggtcttttccgttcttgaagtcatcaacagattgttgattcttatccaagacttcattgatcattggcagaagttgtgctggatcggatagttggatcaatcctttcgctttgacaacttctttggcatcgccgccattggtgatcaattctttaaagacttttttcgcaatcttagaactgatcgttccatcagcaatcagttggatcattcctgcaagattatccggcgttaatttggtttcttctaattccaatttttcactgttcaagtaggccgaaacttcacccatcaaccagtttgatgcttgttttggttccgccccagcatcgatggttgcttcaaagaagtcggacatttctttggtcagtgtcaagaccattgcgtcgtattctggcaatccaagttcgttgatgtaccgttggcggcgtttttgtggaagttctggcaatgtttgccgtactcgttcgatccattcgtcatcaataacaaatttaggaatatctggttctgggaaataacggtaatcagatgatccttctttgacccgcatcaagattgtcttattagtggtttcatcaaaacgacgtgtttcttgttggatctcaccgccagaaagcaatacttttgcttggcgtttttcttcgaaagccaagccttttttgacaaaggacatagagtttaggtttttcaattcggttttggtaccaaaagcttcttgaccataaggacgtaaagagatattggcatcacaacgcatggatccttcttccatcttcacatcagatacttctgtaaattggatgatagagcgcaaagcttccaaataagcataggcttcttctggcgagcgcatatctgcttcagaaacgatctcgatcaacggcgtgccctgacgatttaaatccacataggaatagccgccgatgccatgcatatttttccctgcatcttcttcaagatgaacccgctcaatacggatttttttctttttgcctgctacttcgatctcgatccaaccatcatgaccgattggttggtcaaattgagaaatttgataggctttcggattatccggatagaaatagtttttgcggtcgaaatgagtatctttggaaatttcacagtttaacgctagtgctgctttcatcccaaattctaacgcggctttattcatcaccggtaatacccctggataaccccagtcaatcacattcgtattgctatttggctcggcaccaaaatgtgctggcgccggtgaaaagatttttgagtttgtttttaattctacgtggacttcaagcccaatgactgtttcgaagttcatgcgttattccctcctaaaatcactggttttttcgtatgaaaatcagttgcttgttcaaacgcataagccgcttgatacatcgttgcttcatcaaaatgtttaccaatgatttgcaaaccgactggtaatccttcagaaaatcctgctggtacagacatacctggcaatccagccaaattgactggaatcgttaagatatcattcatgtacattgtgattggatcattgatattttcacctagaccaaaagcaacggttggagatgcaggaccaataatcaaatcgtaatcagcaaatactttgtcaaaatcttgtttgatcaatgtacggacttgtccagcctttttgaagtaagcatcataatatccagcacttaatgagaatgtccctaacatgatccggcgttttacttcttctccgaatccttcactacgagaattgacatacacatcgtctagattttttacgttttctgaacggtagccataacggattccgtcaaaacgttgcaagttagagcttgcttcagaagaggcaataatataataaacggaaacgccatatttagaatgaggcaagctgacttcttcgactgttgctcctaatgctcggaatgtttctgccgctttcaacacagcttcacggacaccaggttgaatcccctcacccatatattcttttggcagcgcaactttcatacctttgatatcgccagttaaccctgcagcaaaatctggtactgctactccagcagaagtgctgtctttggcgtcaaatccactaatggcagacaatgccagtgcattatcttttactgaacgagtcattggtccgatttgatccaatgaagaagcaaacgcaatcagaccaaaacgtgaaacacgaccatatgttggtttcattcctacgattccattgaaagaagcaggctgccggatcgaaccacctgtgtcactccctaatgagactggtacttgcccagcagctactgcagctgcagaaccaccagaagaaccgccaggaactttggtatgatcccacgcattctttgtttttttgaagtaggaagtttccgtacttgctcccatggcaaattcatccatgttcaatttaccgactggtatcatgtctgcttggtagactttttccatcacagttgcatcatatattggttcaaagttagccaagatcttagatgcagctgtagtcagtaggtctttggtcacgatattgtctttgatcccaatcggaatccctgccaaaacattgctttcagaaatacccttctcatcaattgctttggctaatgccatcgcgtttgactcgttcaatgtaataaaagaatccacttttggttcagtcgctttgatttgctcgaatgtctctgctgtcaaatcgacagctgaaatttctttggaaacaagcatgccatggagctcttccaaacttttacttactaattctgtcattacgcaccggcctccccattatcaataattgctggtactttaatgaaaccatcttctgattccggcacattacgcatcaattcttgtcggttccagccttctgctgcgatatcttcacgcatcacattgattgtttcagcaacgtttgatgtaaatggcacaccttctgtgtctacttcctctaaggtttctaccatatcaataatttttcctagctgagaggtaaactcatgtaattcatcatctgagaatgataattttgctagcttggcaacgtgtttgacttgttcttcgcttatcgccataaaatcctcctctttctcgcatccataaaaatacgtttacgtttttccaatgtattgtatcacttttccagcaaatcatgaaatacattttgaaaattatcatacttaattgaaaatgtaggtctcgattttttctgccccatctttacgggcaataaaagcttgctgtttccctagagagccaacttggacttcgatctcgccaggaactcctttgaagacagattcgacttgctttgcgctatactgaacaaaactggtgatctcggttttactgtaataattcgactcgactttcaaaacaagtttttggagttgatcatctacgtaatacgcattgccggtcacaccactcaagtcaggaaagaaactaatgacagcatcacgaaatgttttgaacttattatccaaaccatcatcggtggcagcattggtgacccccgcagctacaggtaaaataatgtgggcctctgctactttctcatactgatcgatagttgttcctccatcttggctgactgcttgataaacataattgcctccggcgatatcatctttagcagcttgttcgaataaaccgatcacgataggtacagtctccaaccctttgatttttcttacttgtgtcaaaacagcattgactgtcttccgcgcgtttgccatccactcatcacgagagatagaaatggtctcgtcgctgccatagtagacggtattaaaggcaaagcctaaactaatacctgccaatgttttgccgtcttctttaataaaatcttgctccatcaattgttgaaaaataagcggctgatctgaaccggcagggttaagaccttgcgggttatcatcagagacacgtttcagccaattcttgatcgtatcagcaggaattttttgaccttcttgaaagtagcacgtatcgacagaaaaagtctgcttggacagcctcagcaagccattctcaaaattggtttgattgaacccgctgttcatttgctctgcattcaatcctctagcagcactcggttggtacttgccgtctgtcatgactgcctgatagacagaattatcgacacggccagtggtaatattaccgctggccgtctcttcaccttcgttgatattcgtgattcctttgttgagattgccgcaacctgacaaaaagcttaacgacatcgcgacgatcaagaagtgtttaatcttcatggttatggctcccttcaatcgctgccaccatttgattctcttcccaaactgtaatgcccaagctttgcgctttcgtcaatttactaccagcctcttctcccgctacgacgatatctgttttctttgagacacttcccgtcacttttccgccaaggttctcaattctttcctttgcttcttcccgagtgaaatgagtcaactttcctgttaagacaactgtcttacctttaaagggtgagtcaatagccgagagctcctcattttttaaaccaaggtaatcaaaattgacccctgctttctccaactcatctaaaagatcatggacttcttcgttgttgaaataagtgacaacactatccgcgatggtttgcccaatcgtttctaaagaaacgatctccgactcatccgctttgcttagattacgcagattgcgataatgttccgcaagaattcttgctgctttagatccgacatggcgaatccctaagccaaatatcaaacgctcaacagaattttctttactggcttcgattgctgacaaaatattgtttgccgatttttctttgattttgtctaatgtcaacaattgttcttccgtcaaataatataggtctgcaacatcagcaactaagtgcttttcatacatttgttcaagaactcgtgggcctaacccttcaatgttcatagcatttcgggaaacaaaatgactcaatccttctttcatttgtgcaggacacttcggattgatgcagcgcagtgccacctcttcatctaaatggaccaattcactgtcgcaaatgggacaatgggtaggaatcggatagggctcactggcttttgaccgcttatccgtcaatacgttggcaacttctggaatgatgtctcctgctttatagataatcacagagtcattcaagcgaatatctttggcgcgaatataatcgacattatgcaggctggcacgacttactgttgtaccagctactcgaaccggcgtcatgaccgctgttggtgtcacaacacctgtgcgtccaactgtccattcaatctcttcaatggtcgtttctgcttcttcgggtggaaatttataagctgccgcccaccgaggagctttaaccgtaaatcctagtgtatcttgatcggagaagtcattgactttgatgacaacgccatcgatttcataaggcagctcactgcgtttttcgtgaaattcttcgatatacgcccaaacttcatcgatcgttcggcacaaacgccgttcatgatttgtccggaaacccaaactgtctaattcatcaagcgctgagaattgatcgtgtgcctcgataggaccgaaatctgccagagtatataagaatgtgctcaaattacggctggcagcaatccgtgtatccagttgccgcaagcttcctgctgcggcatttcgaggattggcaaatacctctaagccctcttcttcccgtacttgattcaaacggatgaaagaagctttaggcatgtaacattcgcctcggacttctaatgaaacaggttctttcaattttaatggaattgacttgactgtcttcaagttttccgtaatattctcgccgactgttccgtcaccccgtgttgcaccacgcacaaaccgtccattctcatatttcaaagagattgatagcccatcgatcttcaattcacagacataatcaacggcacgacctagcgctttttggactcgcgcatcaaaagcgatgatttcttctttatcaaacacatcattcaaactgtacagaggaatatcatggatgaccttttcaaatccaggcagaacgattccacccactcgctgagtaggagaatcttctgtgaccagctgcgggtaatccgtttctaattgaacaagttctttataaagtcgatcatagacgtaatcttcgacagacggctgatccttcacataatactcataggcatattgattcaaagtggttcttaattcttccgctcgttgttgaacttcagttgatggcacagccatttcgattcctccttatagtttttcgatcggagcaaatgctgcaagcagccgttttactccttgttggggaaaagcgacatctaattctagatcctgggcggcccctgtggtccgaacgatcgtgccgacaccccattttttatggttgactttttcccccacttgccattgattgccggctgcagtcgtggtttgtctcgacgaaacagtggactgacgaggttgggtatacgttggtttgaaaactttaggctgaaaggaagcagctgcccctttcggctgagttctttctcccagtgactgcagaagatcttgttcaatctcttccacaaaccgagaaggacgattgtattgagtgcgtccatacaatgtacgagaaaatgcgtttgtcaagaatagctcttcttctgcacgagtaatccccacataagccaaacgacgttcttcttccagttcgctttcttccatcaatgctcgagataacgggaagatgttctcttctagcccaatcaaaaagaccacaggaaattccaatccttttgccgcatgcaatgtcattaatgtcacttgactgctttcttcttcataggaatcaacatcggaaagtaaagcgaggtcattgaggaagacagtcaatttttcttctggcgcatcggcatcatcttcattttgtgcctcaaagcgtttgtcaaattcttgggtcactgttaagaactcttccaagttctccagccgggattgtgattccagattgttctgattgatcaaatcttgtttgtaacctgttttatccaaaatttctttcgtcagttctgtcactgacagataaggaatcatttgggcaaactggtccatcatcatgccgaagctaccaagttctttgccggccttgcctgagatattggctaaatcgacattcatcgcagcttctaacaaggaccattcatgaagcgaagcaaactcacgaagtttttcgacagaagtcgccccgataccacgtttaggcacattgatgatccgttctaggcttagagaatcgcttgggttagcaatggccgaaagataagccaagatatcacggatttctttccgatcatagaatttgcgtccgcccaccattgtataaggcgcgtttgcttttaatagcatttcttcaatcacccgggattgagcattggtccgatacaaaacagcaaagtcgccgaatttacgtcctttatctgcaatttgtttttgcatctcactgacaataaaacgagcttcatctcgttcactatccccgcgatagtaagtgattttttcaccggctctattttcagtccacaaatttttgtctggacggttgcggttgtttttgatgacttgattcgcagcattcaaaatcgtctgagttgagcggtaattttgttccaacaaaatcactgctgcatccggataatctttttcgaagtccaaaatattttgcatattggcaccccgccagccatagatactttgatccgcatctcccacgacacaaagatttttgaagcggtccgctaataaattaacaagcgtatattgggcatgattcgtatcttggtattcatccacatggatatagtgaaattttcgttgataaaactgcagtgcatcttcattttccttaaacaagcgaatggtattcatgatcagatcatcaaaatccatacattgattatttcgtaattccttttgatacagcgcataacagcggcctacgatctgttcaaacaagctcccttgttgattttcataatctgccggagtcaacaattcatttttggcattggagatcgctcctaaaatggaacgcgggtcatatttttttggatcaatatttaactcttttaagactcgtttcatcaaagtgttttgttcagaggtatcaatgatcgtaaagtttctagagtagccgatctgatcaacatctcttcgtaaaatccggacacacatcgagtgaaacgtagagacccaaacatcttctcccccagatccaagaagctgattcacccgttctttcatttctctagccgccttattcgtaaaagtaatggctagaatattccaaggattgacatttttttcttcaatcaaataagcaatccgatgggttaagacccgcgttttgccactaccggctccggccattaacaacagaggtccttctgtatgcatcacggcctctttttgccggggattcatattcgcaagtaattcgtttttggatgacatggttttaaccatcctttctttctcaatccattcaattatagcattatccgattgtagggaaaaccgaacgccttgaaaagttgctaaatttttcttttttgtccttcaaaaaaattccttgttatctattcaaaaaagggctaaattaaataaggaaagtgaggagtttgatgaagaaacatgaaatccattatttagatacaacccgcctggcctttataggcaaaggaatcttgataggagcatttgtggggatcgtggttagtttgtttcgccttgcgattgaatggataggcgaaaaagttgctgctgtctatcgacaccttgctgatcatccagatcagatcatactgtgggtaattctctctatcatcactgtaattattgtgatccttttagtaaaatcagaacctcaaatcaaaggcagcggtattcctcaagttgaagggaagttaagtggcgagatcgattataattggttctctgtcctttggaaaaagtttatcgggggcattttatccgtcggatcgggtctttttttggggcgggaaggtccttcgattcaactaggtgctgctgtcggacaaggtttaagtcagttctttgaagccccaaagtcagaagaaaaaatattgatttccagtggtgccagtgcaggattgtcggcggctttcaatgcaccgattgccggtttgctgttcattttagaagagatccatcattccttttcacctcttgtatggctgacatcttttgcttcagtgatttctgctaactttgtctctttaaatttttttggattgaaacctgtcctttaccaaggaaagatcaatgacttgcctttgaaatattacggtgctttagtcatcttaggtatcttactagggatcttaggacgattttaccagtggacattgctgtctttgcctaaatggtatggaaaactacccatatcctctgactggtatggattgattccttttgtgctgattattccaatcggtctatttttaccagactatttaggcggcgggaatcaaattatcttgactttaggagaaaccggggctcccctgttgtttttggtcatgttgctgattttgcgttactgtttttccatgatttcatatggagctggactgcctggggggattttccttcctatcttaacattaggtgcgctgattggtgcgatctttggtacctttttggcacagtcgatcggtctggatcctatttatatcaagaatttcgtgatcgtagcaatggctggttattttacagcgatcggtaaggctcctttaactgctattattttagtaacagagatggttggatcaatcaatcacctaatgccgttaggactagttagtttagtagcttatatcgtggtcgatggtcttggtggtcatcctatttatgagtctctccttgaaaagatgcataaagaacccgctgtgaatatccgaggaacgaaaacagtgatcgagtatccggtaaccgcagaaagttcatttgatgggatggccgttcgagactttccttggccagaaaacatgttgctgatttccattcgtcgtggcgaaaacgaaattttgacccgcggagatacgatcatgaaagttggtgatgcccttttgatcttaacggattcgaatagtgtttcggaagtgaagaaaaaaatcagctatttagctgatggtcctctgacttaaacattggctgccaaattgccgtcaacatcctcctgtctttatttatcgatcagaaaaaaatcgaaggagcaaagctacagacacatgttctgcagttttgctccttctttcattgccatacaatcgctgtcgtataatattcccaaccgttctttctaaaatcagcttctgaaattagctatagtatttttccaccaaacgttcatccacataaacggaaacttgaccgtcattgactgggaaaattcctttacctgtttcgtctaagacaacttttgcttcattatttttcaaaatatctacgtaagtttcaccaccatgaatggcgctgatggtcatttctttctcagcaccttgggcattcgtcatgaccacggccaagccagacagttcgtgctcataatctcctgtcagtacccaaccgatacaatttgggtcatcgaaataatcaacttgattgccaaaggagattttttcacgcaatttcaggagattttctaaattttctccaactggttcaataccttgttcaggaataccgaatagatccccccagaaaacaactggtactccagcttttcgcaacaagatcaacgcataggcatgcactttaaaccagccatctacccatgactgtaaactctgaccgacttgcgtatcatgattatcgacaaaagtcacagcgtagtcttctcgagaagcagtcaatgtacctgcaaagatttgactcatatcgtacgcaccattcgaatgagatgcttcatagaaattgtaatgcagtggcacatcgaacagatggatcagatttccggaagaatcgagatactcttctagtttcggcagatcacccgaccaatattctcccaccacaaataaatctttgcctttttcttcccggcgattcaaaagccaattaacataataattaaactcaatatgtttgacagcatctaggcgatagccatccacattcgttaactcttgataccatttgccccatttatccagctgttcgatagtttctggattctccatatccaaatcacagcccattagataatcatagttgcccatctcatcatccacttgatcttcccaccctttttgggcaaagttaaacaaggcatgatcgttggttcggtcatcataatcaacgccagaaaaatttttccacgtccagacatagtcattgtatttcccttttcttccagggaaagtgaacttcgtccaagcttcgatctcttcttcatcacttatcggcttgttgcgattgtcccaactgtatttgaccgctggtgccgtttctttttcatcggctcctatcaaatgattgaatacaatatctgcgtaaacctccaacccctgatcttgcaacgctttgattgcctcaagatattcatctttggttccgtacttggttggtattgatcccttttgatcaaattctccaagatcgtagtagtcgtagacaccatagccaacatcttcgacgcccgctgtacctttatatgcaggaggcaaccataccgctgtaaatccataatctttaagctcactactcatttctttcaatctattccaatgttgactgtctgcaggcaagtcccattcgaagccttgcaatatcacttcattcttcatataattcccccctaaaaataattaagccaaagaatagccattcttgtcaaacattaacccatttcgattcttttctgagtaatttgccgaccgtttttgaccgtttaagaatgtattacccttacattttgattgtttttaaacgattgtgattgattatgactgttttatgtgctatcataacaattgaagaggtgatgtaaatgcttacagaagagcgtcatcaaaggattttagcccttttagaagaaacggatatcgtgaaagtcagcgaattgatccatcaattacaagcatctgagtccactatccgtcgcgatttacaagaacttgaagcacagggagttttggtccgaatccatggaggtgccaaaaagatccagcaccttggatttgaacccaatatgaaagaaaaaacgcaaaagttccaagtagagaaacaaaaaatcgcccaatatgccgtctcattgatcaaaaaggatgaggtcatttacttggatgctggaaccacaactttagaaatgatccctttcttgtcatcgatctcaaatgtgaaggttgtaaccaactctgtcaaacatgcggcattactgatcgatcaaggaatcgagacattgattttaggaggaacgatcaaaatcagtacgaacgctgtcttggggagcggtgccagtgagcaattgcgaaaactgcgcttcaatcgctgttttattggaatgaatggtgctcatgtagacgcaggctttacgactccagatcctgaagaagcaatgatcaaaaaaatcgcgattgaaaatagtcaaaaagcttatgtattactggaccattctaaatttcaacaaactacttttgctcaagttgctgccattgaagacgcagagattatcacagacttctgtccgaaaaactatgcggctaaatttcgaacacaaacgactattatggaggtatccgaatgatttatactgtcacactcaacccatcaattgactatattgtccacgtcgaagcattacaattgggcgaacttaatcgaatgaagcaagactttaaacttcctggcggcaaaggcatcaatgtttctcgtattttacagcggatccagatcccttccactgcacttggatttattggcggattcactggacgtttcattgaagattggctgatcaatgaaagaatcacgaccgatttcacacaagttgctgccgatacaaggatcaatattaaattaaaatctggcgaagaaactgaaatcaacggattagggccaacaatctcaaaggatgaaagtcagcaattgaaagacaaactgtcttctcttaccaaggaagatatcgtcattttttctggtagcaaaccaaatggactgacggctgactactatcaagagttgatcgccatcgtcaaagaagctggagccgagttcgtcattgacacaacgggtccagagttgttcgcagcattacccgaccaaccgttgctgatcaaacccaacaatcatgaattagcggaattgtatcaaacgacattccactccttcgaagatattttaccttatggacaaaaattaatcgctgatggcgccaagaatgtcattgtctcccttggcggagatggagccattttctttactggaaacgaaatctaccgctcgaatgttctgaagcgttcactgaaaaactcggttggagctggcgactcaatgattgctggctttatcggacaatatacagcaacaaaaaatgcactggaagcctttaaatggggagttgcttgcggcagcgccactgctttttcagatgatttagccacatcagcatttattcaagaattattgccagaagttgttattgaaaagatactttgacttaacataaggaggataaacaatgaaaatcaacgatttactcttaaaagatgccatgatcatggaccttcaagcaacggataaaaaaggtgtgattgacgaaatggttgccaaactttatgaagttggccgcatttcagatattgctgtctacaaagaagggatcttggctcgcgaagcccaaacatcaaccggtcttggcgacggtatcgcaatgcctcatgcgaaaaatcaagcagtcaatgaagcgactgttttatttgctaaaagtaaaaccggtgtggattatgaggcacttgatggtcaacctacttacctcttcttcatgatcgctgctcctgaaggagctaatgatacccatttacaagccttagctgctctttcccgcttgttgattgatccagaatttgttgagaaattaaagaaagcaccaactgcggatgcagtccaacaactatttgctgaagcagaagtacaaaaagaagaacagacagatgtcataactacagagtcagtgagtgatcgcccttatatcgttgctgttacagcctgtccaacaggtattgctcatacttacatggctgaagatgcattaaagaaaaaagccaaagaactaggcgtagaaatcaaagttgaaacgaatggttcggaaggcattaaaaatcgattaacagaagaggacattgcacgagcagctggcgtcattgtcgctgctgataaaaaggtcgagatggatcgtttcaacggcaaacatctagtgaatcgtcctgttagtgacgggattcgtaagacggaacaactgatcaatgaagctttaagcggtgatgctcctgtctttcacagtagcggacaaacagttgcagaagaatcttctgctgatggtacgtttggtcaacgaatctataaagatttgatgaatggtgtttcccatatgttgccattcgttattgcaggcggaatcatgatcgctatttcctttatggtcgatcaattcatgggtgtaccgcaagacgctttaaatcaattaggtagttataatcaacaagctgcttggttcaatcaaatcggtaatgccgctttcggattcatgttacctgtcttggctggatttattgcatcgagtatcagtgatcgcccaggtttgatcgttggttttgctgctggcgcattggcaaacagtggtggcgcaggattccttggtgcattgattggtggatttttagcaggatatgtcatcaaattcttgcgcaatcttttcaaaggtttacctaagtcattagacggaatcaaaacgattctcttttaccctgtttttggtttgttgattactgggttcctcatgctaatgatcaatgtcccaatgaaagcgatcaatgacggcttaaacagcttcttaacaggattgagtggaacaaatgccgctttactaggtgctctgttagcagctatgatggcagccgatctaggtggtccaatcaacaaagctgcctatgtgttcggtacagcaacacttgccacaacggttgccgaaggtggtagtgtcgtaatggcctcagtcatggctggtggaatggtgccgccattggcgatctttatcgcaacagttttattcaaaaataaattcactaaagatcaaaaagaagcaggtttgacgaatatcgtgatgggcttatcttttgttactgaaggtgcgattccttttgcagcagctgatcctcttcgggccattccaagtttcgtgattggttctgctttaactggtgccctagtcggtgcattcaatattcaattgatggctcctcacggtgggatctttgtggtccttttactatcaaaaccattattattcctattgttcatattaattggtgcgattgtttcaggaatcatcttcggtttgttaaaaaaagaagtaactaccgcttaatacatgttgtgtgaaacaactagcgtctcctatgcaaaaaaatctccagcgtgtttgaaacacactggagatttttttgcgagaatcattcaacttccttgtctttgctattttatatggctctatttatttccagaaatggattggtgttcagctaagcgttccatattcataaaatagacccgcaagcgatgggtttctttttttagattgacccaggtatattttttgctgcgatgcaataaaccaaagcgaacatctgacatacgatctttcaattcgtcgataggaatatctgtcatcgcctcttgcggcaaatagaactgcaaacaaacggtgtattcttcaaaatgttccgtagtgtaatccgcctctaaatgactgcgaatataaaattcataagcatctaagccattatcgagcgttaactgtggttttaagacaatgtaatccatcatccgcatgccttcttggtcgatccaagggaaataagcctgtgcattcaacaatcccctcacccgacgttcttggtaaatctcacgaactaaatcaaagttccgagtgataaaatgggtcgctttgcgtttgacggtgggctgtaaacgatcattttgatattggatcgtttggatcaactgatggccaaacgcgtattcaataaacggttctcgcaaaatccctactccgttatcccaagtaagttgatccaccccgatttggtcccgaaacaaacgttgataggaaaggttggcaggatgatcccattgaaacggatcacggtaaagctccaccatgacaaccccttcctccatcgtttggatttgttctacttgttgggcatctttaataatcactaacggcaacactcgctcatagtactctgagaaatacatgcgccaacaggaagttaaacaaaacccgttataaaaaacatcatatccggcaaattgattgcaatcgatcacgatttctttggcatggttttttcgctttggtaattcagcgatttcttctggtttctgaaagttatagcgtttctctacactttcgacattatgattgaggaattcatcataagctcgaatataactaaagagaccgccttgttccattgtggtctttatataactcagtaatagttctcgcgatccctgaaaaacatcaaatgtaaaaagatgtcgttgcagtacggcttcttggacaacgtgtatactggattcattttgtccatcggttaaaatcagttcaaaattgacctcgtcaatacttccctccagcaatgagcgtacttcagcgatatcataggagtggatttccttttgatttaaatagtagctggtgggggtaaaggaaagacggaccaaagcgaaccagttggctatttgttcacgcatcagagcatcggcgagttgtgccgattgaataaaggcatagattttcttcgttttgatcatctttctcacctctttatgtacttcttattttattatagtaaagggattcatgattgaacactatttcgcttacttttgagatgaaaaactttggttttcatggtaaactagaggcgcttggaggtgggaatatgggattaaaattccaacgtgaagattctcttgataaaatgttcgatgtgtttgctattcttcccgacaatgacaaaaaagagaacaaacccgacatcgaacgcttcttgaatgcgaaagaagataaagaagaaactgaaaaaaatacggatcttaaaaaacaaacaaaaaaaacatcctaatcgatgttttttttgtttgcacagaatttttccgataaaagatgttccggagcaaactttctccgtttattttctagtcctgagagattgccccatgcatcttacctcttatctattattgcttgatggccgcttctatcgcttgccaagcttcttctttcccctgtttagtgatggaagaaaaaagaataaaggtgtctgctggatcgaattccagcgcttttttgatcacactttcatgcttgttccatttcccgcgaggaatcttgtctgctttcgtggccaccacgattactggaatctcataatatttcaaaaactgatacatttgaatatcttcctgagaaggcgcatggcgcagatccactagagagacgactgcccgcagctgctgtctctctgcaagatacgtctcgatcatcttcccccactttgcccgttccgtttttgaaacttttgcatagccatatcctggcacatccacaaaatgcaaggtgttttcaatcaagtaaaaattcaatgtttgggtcttaccaggtttcgaagacgttcgcgctaaattttttcgattaatcaatgtattgataaaggaagacttcccaacattggaacgacccgctaacgcgatttccggtaaatgcgtatccggatattgtgccggtgaaacagcactgatcacaatttctgcatcatgtactttcatctgctcgctcccttctaataaaatctcatatgctttcagaaagaaagtcggatagtcatcaaactatccgacttactaaaatcaaactgctttttttgtttcttcattataaatgattgtcggttcaccgatttctttggctgcatcttcggtaataatgactttttcaatcgactcatcagaaggaacattgaacatcacgtccatcatgatattttcgataatcgaacgtaaaccacgagcacccgtattgcgttcgatcgctttatccgcaatcgcgcgtagagcagctggttcaaactcaagctcagtatcgtctaatgctaacagtttttggtattgtttgactagcgcatttttcggctccgtcaaaatacggaccaagtcatcggtcgtcaatttgtctaaagctgccataaccggcaaacggccaataaattctgggatcaagccgaatttcaacaagtcttcaggaatgatatgttgcatgatgctttcatcttctgagaaccgtttgttgttcgttccaaaaccgatcgttttttcacccatccggtttttaacgatggtatcaatcccgtcaaatgcaccaccaacgatgaataaaatattcgtcgtatcgatttgaatcatttcttgatgaggatgcttccgtccaccttgaggcggtacacttgcttgtgtcccttccaagatcttcagcaacgcttgttgcaccccttcacccgatacatctcgcgtgatcgaaacattttcgcttttacgagcgattttgtcgatttcatcaatataaatgatgcccttttctgccatttcaacgttatagtccgctgcttgcagaagtttcagcaaaatattttctacatcttctccgacatatccagcttccgtcaagctggtggcatcggcgatagcaaatggcacattcaatgaacgggccaatgtttgagcaaggaacgttttcccagagccagttggtccaattagacaaatattgcttttttgcaactcaacgtcttctgcggtcggctcaacgttcactcgtttgtaatgattgtaaaccgctacagcaagtgtctttttcgcacgatcttgtccgatgacgtaatcatttaatatatgcagcaattcttgtggtttaggtacctcggtaaattcacgaatggcttcttcgtagaactcttcgtcaatgatctccttgcacaagtcgatacattcattacatatgtatacaccaggaccggcaacgatcttctttacttcctcttgcgtcttcccgcaaaaagaacaacgaacagcgtcatttccatttgtgttgtcgtacatactgttcaccccttgataaatttctaacctgtaaaggagtggaattggttttactatctttacagtctttaatcatcttatcataactcatttgaaagaaaaagctatttctcatggccgttacgttttcttagcaattgaccacgtccgcaaaataagtcaagatcctcctgctcaaaaaggcaaagtaagcaaaaaacgatcgtatgaaatatacacaccattgctttttgatcaatcaaaaagggcaaacatcggaaaagacgtttgccgctcttttgatgaaaattaagcttctttcgccgtaccagttacgatttcaacggctttcttcattgtgatgtcatgtttcaacatatcttctgtcaagacgcgtttgatttgatcaacaggcatgttgtaagcttctgaaagctcttgaatttctttttcgatgtcttcttcagttgcttccaaaccttctgcttttgcgattgcttcaatcacaaggttagttttcacacgagtttctgcttcgccttcaaattgttgatgcaagtcagcttccgttgaaccagtcaattgatagtacatttctggtgaaattccttgacgttgcatgttgttcaagaactcatccattgagcggtgaacttcgtcatggaccattgaatgtggtaattcaacgatttctgcgttttcaactgcttggcgaatcgctgcttcatcttttgcatcttcagcagctttttcttttgtttctgtcaattctttgcggtatttttcttttagttcagcaagtgtttcaacgctatcatcaacatctttggcaaattcatcatctaattcaggcaattcttttgctttgacttcgtgaactgttactttaaagaccgcatctttacctgctagatcttctgcttgataatcttcagggaaagtgacgttgacttctttgctttcgccagctttcactcctactaattgatcttcaaaacctgggatgaaagagttagaacccaattctaatgaatagttttcgcctttgccgccttcaaatgtttcttcacctaagaaaccttcaaagtcgataacgactgtatcgccattttcagcagcttcgtcttctttgatgactaactcagcttgtgcttcttgttcacgtttgatgcgagcatctacgtcttcttctgttacttcacgatcttgtttttcaacagtcaactctttgtaatcaccaagtttaacttctggtttcacagtcacttctgctttgatcacccagtcttgacctttttccatgctgtcaacatcgatttttggttgtgatactggatcaataccagcttctttaactgctgcttcataagcttctggcaagacagcattcaatgcatcttcatacaatgcttcttctccgtacatacggttaaatacttggcgagatacttttcctttacggaagccaggtacgtttaagttgcctttcactttattaaatgcagtcgtcaagcctttttggatttcagcttgctcgatcgaaaatgtcaatacaccatcattggtgcctgttttttcccattttgcagtcatttatttccctccgaataacaattatattttacatatgaaatagtttcatgcatacctttaaatagtacactaacgttctttaattgtaaacattttacctagaaacttctcgtttttttcttgagtgatctgctttcagaattagaaagaacccaaaatctttcgtaatcttgttttcttacgttggatctcctcgtcgatcgcttgtggttcgctttttgcaaaaagatcttgatactcatcgatatagctttgtacccagcgatcaatctcttgggtttctggcaagaacggatagcttaaagcaaaatgatcattcaactcttctaaaatgccttctgctaaggttggattttcttgcccgattcgttcattcacagcttgtcgcatttggctgaaaactggcacttccctcaataaagataactgattgggaatgatctgccgttgatcccccatgtagtctatcaattcaaactgctgtgaacttcctaaacggacaagttcttctactagttttggtaacaaaaaaggattcgttaactgaggaagcagctccgtcatcaacgatacaaactgatcctttgtgagtccttgggaaaaaacgtgccatgtgtgcccgctaactggttggttgctgctgtccattgcaagcaatgactgtttttttcctaaaaaatcttccaaaccaagtatttgttgaacttcttctactttatccaattctttcactaaagtttcgcttgccgcttcagagatcaccggaaattcctctgcgagtcttatccattttctcgcttgcaagtattgaccatcaagaatcaacaaatgaccaatttgaacaaaaccatttggatcttgtaggtattcatccaagaaatcatctgccacttccaacgcttttgcaaaatcagccagttgctgtaagcacttaacgagagactgattgatctcaaaagaagaatgctcagtataaatttcctggtaatcatggtaagccttcagataatcttttgcctgatatgctttttctgctgaatgacgcaggcagtcttcaggttttggaaactggatcgtgtctcccatatctcattctcctttatctgtaatcgatctgcaatcgcacttccgcttgtatggtgcaatcttctggtagcaagaccgcttttcaacgggtcagtcttcgtttgcctcaaatagagactgaccgctcattacgctattgtctattcttgttacatattggcatttgcctgtttattgaatgctttaatcaaattgatagtaaccacactggtctcagaaaaataatctccggcatgctgcttttctttagtaaaaatcactggcaaataaccgcaataaaagaaaggattgaattgcaaaacgtagcgcatacacagttctcttgtcagaactgttttccaactcaaatcagcttctgtaaatgacacgacccgaataccgaaaatcatcttacctaccgtttgtccctgattgaactttgttaataaaacaaaatagcctaagtagatggccaacgagagtaactggtagagtccaaaaggatgcccgctacttgaccaaccacctaagtgatagatcgtatccagagtaattcctgtaatagctccgatacaaagtacatctacgagataagcaaatagccgaatccaaaacccagcaaaaaagtaatctggaaaatcattcactcgtctgcgttctttctgtttgtcttctatcccctcataccgttgccattctttttgtcgctgatcaatctcttcctcgctaaattcttttctcttaaacgagcccaatacttgttgatagaaatcatctggatgattcgtcacagcggcctcttgatttggggtatccacagctagttgtgcttcttgattcgcctgctctgtagagattccagaggtcgactctagattttccagagttacgttttctgctccctgttcaacaggttgttgtttgattcgtggctctttcgtttctttttcaggcatagttattcacctccataataataaagaggtttcggcgcatccatcgtacccaggctttctactacttgcaaaagacgactagactcagatgccttcagcccttgaaactctgccagctttgaacccagccatgtagaagcgaaccctgtggaaccgacaccatattcaaaaatttccgcatcctctaacccttgatctgcttctaatgcagcgaaggcgtcctcaggaaacccaatttcgtcaactaacccgttctccacagcttgttgaccatcataaatccgtccgtcagcaatttttctaacagcttcttctgacatgcctcgtccttcagctacaatggaaacaaagcgtccgtatgcattatccacgtaagtttgcagaactttcttgtcctcatcggtagcggctcttgtagaggaacccatatctttcaaggcaccacttttataggtgctatcttcgatccctaatttatccaataaacctgaataattcaatccagacataataactccgatagaacctgtcacggtttcatctgtggcaaagattttgtccgcacccgctgagacataataaccaccgctagctgcggtgttcttcatactaacatagacaggaattccaatttctttgatctttttcatttcacgagcaatctctgcactttcgtaaactccgcccccaggcgaattcacttcaaatagaatccctttgatcgttgggtcctcttgcgcggcacgtaattcttccagaaataattgatgatcatatccttctgttgagaacaatccaccacctgaagtattcgcaatcgtcccttccaaagtcaagcgaaggatgcggttattgctatctccagccgctatttgatgttcctccaattcattgcttccgtataaaagagcattcaatccgtccagtgacgactcttcatttgctggcggagccatcaaagcaaaaacacctgagcacgcaaacaatccaattgcaatcgcaacagccacccatcttctcttattcatttttccactcctttttaatagcggttctcaatcacaattaccgcttcaactagtccacttgcatcgaatttttcgcttttttctttcaatgcgtagccgccgaaatattctttagttaattcatcttgcactcgaaacgcttgtgcttcttgaacagagattgcacccggaagaatttcctgcaggctgtcccaaccagtgtctaacatgatttttgtatcatcattgacattttcttgtttctctaatctttccactatttcctttaactcggaaaacgtcatacattgtacagtttctgacatcttcatccctcactttcttctgtcattgtatcgaaattaaaaaaaaaaggatagtcaaaaaggacaattccaattttacgaattggatcatccgcaattctccttctttaaatctccattacagaacaaacattgcctctgataacatctataccaattattttttttagctttttctattgactaacgcccttataaatattatgataatgcatgtatttctacaaaataatttaaggaggatagatagaccaataggaatagcgccagatctgtacaacagatgacgaggaaagagtttatcgaagttttcggcgggtaactctagggactgcactctataagcaagaacaaaacctcatcgtgagatgaaaacaaacctcttgctgcgcaggtagaaatacataatgaatcgtaaataagtagtggaaagtaggatttgtcattatgtgtggaatcgtaggaattgtaggaaaatcaaatgctgaacaagtcattttgaatggtttggaacgtttagaatatcgtgggtatgactcagcaggtttatatgttgctgatcgtacttctggccacttagtcaaagcacaagggcgtatcaaaaacttggaagacaaagtcacaccagaagtaacaggaacgatcggtatcggacacacccgctgggcaactcatggtaaaccatcagaaaaaaatgcccaccctcatacttcttctaaccaagaattagtactggttcataacggagtaatcgagaattttgaagaattgcatcaaaactatttaaatgatcatcacttcgaaggacagacagatacagagattgtcgtccacttgatcgaagtattgaaaaaaaacctttcgactaaagaagcgttcaaaaaggcactctcattgattcgtggttcttatgcctttgcattagttgataaaaatgaccctgaaaccatctatgtagcaaaaaataaaagtccgttattgattgggcttggggatgggtttaacgttatttgtagtgatgcattggctatgctggatcagactactcatttcgttgaaattgaagacggtgaaatggtaactgtgacggcagaaacgattgaaatcgaagacctaaaaggaaatcttgtttatcgcgagtcttatgaagcacaacttgatttaacagacatcgaaaaaggaacgtatccttactatatgctgaaagaaatcgacgagcagccagctgtgatgcgtcgtctcattcaagagtatcaaggcacaggagaagtgacgatcgatgacgcattaaaggatcaaatgattgcgagcgaccgcatctacatcgttgcttgcggaaccagtaatcacgctggttgggccgcaaaagcgattctagaatctctgacacagattcctgttgaagtacatttatcaagtgaattcggctacaacatgcctttgctgtctgcaaaacctttctttatttttctatcacaaagtggagaaacagccgacagccgacaagtcttggtaaaaatcaatcaaatgaatttgcctagtctgactattacaaatgtagcaggctcgactctttctcgtgaagctgaccatacattgttacttcatgccggacctgaaatcgccgtagcttctaccaaggcctatactgctcaaatcgcagttttaaccttattagcaaaagcaatcggtgatgctaaaggtattggtgctgcacaggacttcgatgttttccatgaattaagtattgttgcctctgctatggaaacattagttgatgaaaaagcagtcatcagtcaattagcagaagattatttgtctgttagtcgcaatgcgttttatattggtcgaagcaatgactattatgtttccatggaagctgcactgaagctaaaagagatttcttatattcaagcagaaggatttgcagctggcgaattgaaacatggaaccatcgcactgatcgaagaaggaaccccagtcatcggaatcatcactgaagaagtgaccggctcccatacgagaggaaatttgaaagaagttgagtctcgtggcgctcatactttagtcatcgtcagccaagaactagcgaaagcgacggatcacattgttttgccttcggtccatccattggttactagtttagttgccgtgattcctacgcaactgttggcttactttgcaacattgcaacgagggtatgacgtggataaacctcgaaatttagctaaatcagtgactgtcgaataaaacttttaaaagtttttaggcagaaaaaagagctgcgacaagacgattgtcgcagctctttttttcgtacaaccaattaaaagcaatttttttagacaagctgaaactgcttggaattgcctattttgatcatcctttcttttctcgtccctcaatttttttaaagtcttttaagtaatgcacaaaacagcaagcagcattcatcccagattcattgcacctctgttgatcaacataggagaaatgtatcatttttttacacaccacgtgccatttatgatgattatccctactatcgtcagtaaactagttgcaacgaataaaatattccccattaatgaccagtgatcactaaaaagtaatgaaagcaggatgaaagcacccagaaccaacataccgatgccattcgctacatacaaacgatctaaatcatactgtgcctttttttcttcagaagccatattgtatccagcaatcaattgccatccatgtctgcttaaaaataggatacctgtaataaaaaacaaacccacgactaaccatcctgttgtatttcccatcacacattcatcctctctacacgtctgcctaacgtttagatccattcaccaatcggtttcttgcgctttatacagtgagtataccacatgaaaatcattatttggattatcattatattttcacaagataaaaaaaccaacgaaaacgactttcgttggtttctgatctcatttattccgcaccgatttcttcccgtacgacagctgcgattttatcgacataataatctactttttctgttgttggtgcctcagccatcacgcgcaatagtggctctgttccagaagggcgtactaagattctaccttccccattcatttctgcttctgtttcttcgacgatttttcggattgccggtacatccatcgcgccatttttatctgtcacacgaatattaactaatttttgcggatagatcgtaacttcacctgccagctcagaaagttttttcccagtctgcttcatgatattcaataactggataccagacagcattccatcccctgtcgtattgaagtctaagaagatcatgtgtccggactgttccccgccaaagttgtagtcatttttgcgcatttcttctacaacgtagcgatcacccacttgagtaatcacatctttcaaaccaatggcttcaacagctttatgaaaacctaaattgctcatcacagttgtaacgatggtatcttgtttcaaacgtttttgttcagctaagtattttgcacaaatgtacatgatcttatcgccgtcaacaatattaccttgttcatcaatagcgatcacccgatcaccgtctccatcaaaggctagtccaacatcggcccctttttcgacaacgaactctgctaatttctcaggatgagtggaaccaacaccatcattgatgttcaaaccattcggcgaagttcccatggtataaaaatcagtttctaagtctgcaaacaaccgattgacacttgtagcagtcgccccattggctgcatctacacagacggtgatgccctctagatcacccgggatcgtttgacggagaaattgggaatacttcaaaagaccttctggaaattcatcaacggttcctaaaccttcagctgacggccgtggtaacgtatcttctgcagcatctaataaagcttcgatctccgcttcttgttcgtccaccaatttgaagccatcattaccgaagaatttaattccgttgtcttgtgctggattatgtgatgctgagatcattactccagcactagctttttggacccgtgtcagataagccacacccggcgttgagatgacgcctagttgaaacacttcgattcccacagatagcaaaccagcgatcagtgcattttctaataactgaccagagattcgtgtgtctcgcccaactaagacgcgaggtcgacgatcgtctgtttcatgttgactcaatacatatccgccatagcggccaagtttaaatgctaattctggtgtaagttccttatttgcttctccacgaacaccatctgtaccaaaatattttcccataatgtattaccctctcttattctttactctcatctgaagttgtaacagttgtttcgctttctgaatcacggttttcttcactagtagatgattcactagtttcatctgatcgagattcggcagatgactcgttgccagtttgaccattcgtttccgttgattggaaaacaggtgtcacttggatcgtcactactttaggatcaatcgtcacaccatctggcactggcacttcaacagttcgctcaacagttgaggtgattcttgaaatatcgattggtacgccaatttgatctaatgtatctaaaatagactggctaccagaaatcgttccgctgattgcactcattctatagataaaatgggagatgccgttaggaactgttccttgctgggtgacgaataattccacttgttttgtcggggcttctaatgttaccgttacgttaactgtttcgggatctggcaaaattgctaatgcatttttagcggtatcccacgcttgtatcgttcctttgactgttgaagaggacgttccgatctcattaggatcaatgacagccaccacacgatcgatatcatttaaggtgcgatcacccgtagtgatcgctactttctgaggatctgcctctagagaagcgatagaatacccttcctttatatctgcgcccgatatgactggttcaacagtaaatgtttttgttactttcttttcaatagtcactgtgatggtcttcggctcgatttcagctgttacacccgaactcaaattctgaacttctaaaggaacttcatgcgttccttcccctaattcagagagatccgccatcacgcgaaagtttcgtgtctcatcatttttttctgcattcaactggatacgatttcgacttttcaaggtgacattcacggtggtttcatacccttggataaaatagctatctgtatcatacgtcgtttggatgggaacattgctaagatgttcttcataaccactagtagagccggatagattgacttgcagtgtggaaccactagcaataaaaaacaacaccaaactaaagaacagcgctagtataccataaaaaatatttcgttggcgttctttcttaatcattttcttccccctttgttcacaccgtcaaggaaagattgcagtagattacgttttgctgttttttcttcaggcacaagctctcgattcaaaatatccaagtattgttctcgagataacccagataacaattggttgttcatagtgatactgacatccccagtttcttcagacacaacgatcgtcaaagcatcactgacttctgacacccccactgccgcccgatgcctagtcccgaattctttaggaatcaacaagctttctgaaaggggcagatacgcactcgaaaccgcaattttgccgtctcgtataatgactgctccgtcgtgcaaaggtgtgttgggaataaaaatattgatcaatagttctccggtaatatcggcatccaaggcaatcccagtttcgacatactcttccaaaccggtagttcgctcaattgtaatcaaggcacctattttgcgtttcgccatatactggatcgctttatctaaagattggaccatcacttcgtcttcgtgcttttcagacttagaggtcttgaatagcgaactccgacctaaatgttccaaacctcgccgaatctccggttgaaaaatgacaatagcagcgatcaccccataggtgattacttgatccatcagccatgagagagttctcaaaccaatcaaacccgctaaaaaacgtaagacgataaacagcccgacccctttgaatagctggatcgccttggtccctctgactaactgaatcaatttgtagaccacataccagacaactaaaacatccaaaacattgattaaaaacgaaatagaaaatatattaaacaagaaaacttctctccaataatcaaaattaaaaaaatcactgaaattcatcgacataaacagccttcctttattcttaagacttcaaataatagtataacataggacttcttttaacacgttgaaaaaaagcaaatttatctcattttttcaaaaaaaatctcacttttttctggactctcgattattggataacacggttgatctttacgtaatggagcttaaaaaaaacagctctgccagatactggctagagctgtgacacttgcctattctgatttttttctccgctccgctctggcagctcttcttgccgcgcgaactgcttcgacttcaggatcagagactgatctacgctgtttagttctaacagattctccttgtttttccaccgattgaggttctgcttcagacaatggctctttttctaattttgctcgaatcttttcttcttgcccagcaagacgcgcataattatagaaacggtttttggcatccaagactgtttttgtgaataatgcacttgcagcacttgggttagctgcacctaaggctgaaaaacgaacctgtgttttcataaacgttggcatcaacgaaaaatcaggttttttatagtctagtgtcattgctggcttacctttttcagtcattaatgggttgtaacggtatagagaccaataaccggaagccactgcttcttttgcttctttgatggattgtctcatgccacctgctaatccatgggtgatacatggtgtataagcaatgatcagagatggtccagggaatttctccgcttcttcgaaagctttgatcgtctgcatttgattggctccggaagcaatttgcgccacgtatacatgaccatatgtcatagccatcatccctaaatcttttttcgacacatatttcccactagctgcaaacttagcaatcgctgaagttggggttgctttagagacttgcccgccagtatttgaatagacttcattatctaaaactagaatatttacatccgcgcctgaggccaagacatgatcgattccgccaaatccgatatcgtaagcccaaccatcgccaccaatcatccattgacttggctttacaaacaagtcgctgtcgtcaagaatcgcttgcaaacttggctgttgatgaatttcttgttgtaaagcagcctgtaattttgccgccctctgttggcttcctgcactttcttcccgatgatcgatccagtcttgcataatcccttgtagatctatcggaacagtgattaaggctgccttcatttttgctgctaaggcttctcttcgtgtttgatttgctagaaacatcccataaccaaattcggcattgtcttcaaatagtgaattggaccatgccggtccttgcccttggtcgttggtcgtataaggagacaccggagcagcgccgccccaaatcgatgagcagccggtggcatttgcgatcatcatgcggtctccgaacatttgagtcaacagtttgacatacggagtttcgccacatcctgcacaggctcctgaaaattctagaagcggtttattgaattgggtgcccattacggtacccggttttgccggattctctttctgacgtagtgtcatagcaaaggcccaattcattgcttgctctttttggctttcataagagctcatgaccaaagctttgtcctttgcgggacacgcttcaacacaaagcccgcagccagtacaatcttcaattgaaacttggattcgatacttctgaccatcttttcctcgcatttcttgaacaataaacccttctggtgcctctgtcagttcatcttcatccactaagaaaggtcgaatcgctgcatgcggacaaacaaatgcacattcattgcacatcgtacaacggtcggataaccattctggcacttctaaagcaatccctcgtttttccactgcagtggtccctagaggcatcgctccttccgtcatttgattccgaacgagcgtccccactgataattgattgccttcctgtcgattgattggctcaacgatctcccgaacataacgggatgttgcagttgatttccgttcaggcacatcaatgaaggcccattcagctggcacttgaatctcgtaaagcaattcaagggtccgatcaatcgctaaatagtttttttcgacaatttccatggacttatgtccgtaattctttaatacctccgcttttaaaatcggcagaacctcgtcgaaaggcataatatcagacaaatagaaaaaggcagtttccattgccgtgttgatgcgtctgccgagcccggtctccattgctaattgcatggcattgatggtataaaaacggatgtcattttctgcaatgtaacgcttgatgtgtttaggaagactagttgcaatttgttgctcattccaggtggtatttagtaggaaggtaccgcctttttttagccccttcagcaaatcatatgtatgcagatacgcaggggtatggcatgcgacaaagtcagcatgctcgatcaaataagtcgagcggatcggtgtgtctccgaaacgcaaatgggagactgttaatcctcctgattttttggaatcataataaaaataaccttgaacatacttatcagtgtgatcgccaataattttgatcgctgatttattggcacccacggttccatcggagccaaatccccaaaatttcgcctgaaatgtattgggattggtcaagtccaaagtagcttccgtgttcaacgagagatgggtaacatcatccatgatcccaatcgtaaaccgtcttttttgctcactttttggtttcgtcagttcttcgtatacagcaacgatttgatctggcgttatatcttttgaacccaatccatagcgaccaccaatgacagctggccggatcgctgcatcataaagggcactttggacatctaaaagcagagactcaccgtttgctcccggctccttgctacggtctaaaacggcaattgctttgaccgttgatggaagtttttccaaaaagacttccaatggaaatggtcgatacaaatgaattgtcaagaccccgacttttcttccttgtttgagcaaatgatccaccgtctgttgtacagtctgagccgaagaacccattgttacaattacttcttctgcatcagcacagccataataatcgaccaaatcatagttggttccgcgcaaatcattaatggctttcatgtatttgcgaattgttgccggtaacgcatcgtaatgggcattgaccgtttctcgctgttgaaaatgaatatcggggttttgattcgttccgctaaccgttggatggtttggattcattgccttttcgcgaaaagctgctaatttttcttgatcaatcaattgagccaattcactgtattcaagtacatcaatcttctggatttcatggctggttcgaaaaccatcaaagaaattcagaaagggaatcccactttcaatcgccgctaaatgagccacaggtgcaagatccataacttcttgaacactgctttccgccaacatcgcaaagcctgtttggcgagccgccatcacgtctgtatggtcaccaaaaatattcaatgcattcgtagtgactgctcggctggcaacgtgaaatacgccaggcaaacgttctcccgcgattttgtacatatttggaatcatcaacagcaatccttgcgaagctgtataagtcgtcgttaaagccccagtctttaatgaaccatgtactacaccagctgctccggcttctgactgcatttcaaccactttcactggttgtccaaaaatatttttctttccgctggcggaccattgatctaccaattccgccattgttgaactaggggtaataggatagattgcggctaattctgtaaaagcataagaaatgtaggctgccgctgtatttccgtccattgtttttttcttgcgcatctctctaacttcctttatcttccattttgagcattctcacacaatccattatagctgaaaaatctacttgaataaatactgcaaatcaaaatagcagcgatttagtgaaagagcaaacgatacagtttctatctaatctaagattttttcacaaatttcatttggttgtttctccttttctttctagttgaaattctgttaaacttaaaaaaaaggaggatgaaacatggatatttcaattatcaaagctaaagaaacaaatacgactactggaatcaagattggtgatgaaaatgctaagccaatcattgaattcatgaatcttcgttgtccttattgccgcaaatggtttgaagagtcattgccgatcctaaccgaagctgttgctgcgggaaaagttcaacgagtgatcaaattattcgataaagaaaaagagtctcttcaacggggaaatgtgatgcatcggtttgtagcaacggataatcctgctcaaacgatcgcagatattactaaaatctatcaaacacaagatcaatggggacatttaactttagaggaggttgcagaatttgcgcaaaaccagctaggattaaccgaacataaccattccacgtatgctggtgaaatcgtggaagaagcccgaaaagcaaatattcaatttgtgccgaccgttatcgtaggcagtcacattttcgatgaatcaatctcagcggatgagttgacacaattgatcaatgaataaaacctgtgccacagttctaacagcaacccactcttgaaggataatcgactcgcacgtgcggtccaacgaagccaaaactacttgatacttagccgttttagcttcattctatcccttcaactgttgtcttgttatgacctgtggcacaggttagtttaactgactttatctcgcaaacgatccgcaaattcattgattttacggattcgatggttgatgcctgatttggagatcgctccagaaggaatcatctctcccaactccttcaagctgacttcaggatgttccaatcgcaattctgcaatttcctgcagcttctctggaagagctcccagccccacccgttgttgaataaattcaatattgtcaatctgtttggaagctgcatcgatggtcttgttcatatttgctgtttcacaattcaccaaacgattgactgaattgcgcatgtcgcggacaatccgaacatcttcaaacttgagcatcgaattggtcgcgccgatcaatgtgagaaaatcggcaattttttctgcgccctttaaataagaaataaagccatttcgtcgttcaagggctcgcgcattcaatccataatagttcaacatatcgcagatatcttgattgtgctcttcatagatcgaatagatttccaaatgatagcggctggtctctggattgttgactgaacctgatgccataaatgccccccgtaaataggaacgcattttttgggcattccccataatttcatccgatacatgactatgaaacatcaatccatccataatatctaaatctagcaatacacgtttggtctcttgttttaagcgaacgatgtaaacattgttctttttcaacttcatttttctacgaaccaacagctcacttcggacattgtagtgatctttcaataaggaataaatccgccgagcaatggcagcattttctgtttgcacattgagaacgaactgctggttgttaatacttaacgatccattcattcgtatcaaagcagctaattctgcttttgcatgttcccgatgtacttctagtgatgtcagttcctttttgacttctgctgcaaaggacatagcgtcgcctcctttctagattttggcaccgtagacgatccgcagtaattcatcgatcactttatcaccgtcatgaaagacaccgccatcacgtaactctaagaaatccgctgaaaccacgcgacaactttcattccgcagtccttggaagtcatgtttcacttggacaaggtattcatcgtagatttctggatccatatagccttctgggaccttctctgtattgactaacacggtatcaataaaagacttccctaaatgttgatgcaaaactcgaacatgatctgcatcagtaaagtgttctgtttcccctttttgcgtcatgatattgcagatgtaaacagtctccgctgccgtttctagcaacgcctgtccgatctcactgatcatcaaattcggcaagatactcgtaaacaagctacccggtcctaatacgatcatatcagcttctaatatcgacgtcacaactttacgtgcagctttgggttcattttcgtcatcttgattccgcacaaacacgtgatcgatggttttacgatccaaggcaattttggattctcccactgcttctgtcccgtctttaaaaacagcgtgcaaaatcaaaggttggtcagaagagggatagacatggccatcaatgtgcatgatttttgaaagtatctggatcgcttcataggtactgttgcgcatttccgcaatggcggcaatgatcaaattacctaaggcatggtttgcaagaaatttgtcttctttcttgaaccgatactgaaaaatatcattatagagttgcggcatatctgacaaagcagccagcacattgcgcaaatcacctggaggcgaaatagacgaaactaggttgcggatctcaccactgctgccaccatcatctgcgaccgtcacaattgctgtgatatcaacaccttgattccgcaaactttttaaaatgaccggcaggccagttccgcccccaatgacaacgatcttaggtttacggattcgataggttttcattttcatgatcgattcaccgtctctttgcgcttatctttgtcacgatgggtcacattgactttgtaattttttgctaaagcagcgctgatccgttcagataaagcgaccgaacgatgttgtccgcccgtacaaccaattgcgaccgtcaaactggtttttccttctttgatatacccaggcattatagtttcaagcaatgtctcaaattgctgataaaactcttcagtttctggaaaagacatgacatagtcatatacggtttcatcttttcccgttagcggacgcaattcgggtatataatgtgggtttggtaagaatcgcacgtccatcacgatatccgcatcgataggcaatccgtatttgaagccaaaggaaacaacttccacccgaaatccatgttcatgggaagaacgaaattcttgattgatcttttctcgcagctgtcttggtgttaaagttgtcgtgtcgatcacgatattcgcttttgtcttcaagtcttccaagatcgcacgctctttacggatcccttccgttattaagccgtccatcgcaaggggatgggctctgcgtgtctctttataacgagaaaccaactcattgtctgtagcatctaagaacaatatttttgtatcgatgaatcgagtattctcgatatcgatcagcatgctttggatttcttcaaaaaaggaacgcgaacgcaaatcaacgaccaatgcaattttggtcactttccctgactctttgatcaattcccagaatttaggaattaaactcggcggcatgttgtcaatacaaaaatagcccatgtcctcaaaactttgaatagcaacggtttttcctgctccactcataccagtgatgatcactagttctaaattatctacttctgtcatcgtaaaactccttcctcactcattaacagtatatcatgccgggcgtatcatttaaacactaccgcacaaaaaaagcatcaacatgagagttgactcccatgtcaatgcctcgctcaatttcgataagttaacgctttttcaattgttcgatcgactaaaatcgattgcgcatcgactaccggataaggattattttccgtgaattcttccatcaatgaaagttcggtacagcctaggacagctttctcacaaccaattttatgtgttacttcttctaagatctcaaaataaagatcttggtctaatgtatcagattctttgatccgatcataaatcaatgtatttactttttgttgtaattgcggctcaggcaagtagacatcaaagccacaagcacgtaactcggcttcataaatcccagccttgatactaccttctgttcctaaaaaggccactttcccggtaacaccttctttttgcaaagatttagcagcttcccgcggcatgtgaagtagcggaatcggtgtggcttcttgcaactgatcaaagaaataatgcgcagtattacatgtcagtacaataaaatttggctgtaataagttctgtttagcgatgtcatcaagcaaataaggaacaggatcttctaaatcgttgttcaagatatacgcagtgcgatctggcactgtcgcatgattgaataacacatagttcaaataatcttggtctttatgagcaacggttcgacggttcaagattcgtacaaaactttcagtcgccatcgttcccattccacctaagatactaaagaagttttccatagactagccttctttcgaatggaaatgcagtttaaatcgtttgttgtaaagatagaacattctttttagtagaatccaacgtttgatggagagatctttgtcataaaaaacggtagtcccccagcgattttcggctagcagctttttagcccgttctttttcttcattttcattggcataatccaaaaagatgtttttcggtacacccaaccaaagcttcgctgttggagcatatgctttcccataaacagtttcttggaaaggcacatcaaatactaagtcttctgtcagaaatttagcaagattcaatccacttaatgtgatgaaaaagctacttctcccctgacgaagattgatttcaaataatttgtattgcccatctcggctatcatatttcaaatcaaaattggcaaagccaacatattgaatttgttttaagaacgtcgaaatcatttgatagatttgttggttttcatccggcagaataaccacgtaattgccgactgctccaggagttggatcttctaaaagtggatgacccaatgccatcactcgtacattatggtctttgtcaacataggcattcagcacacgcatattgctgtcatcccctggaataaaatcttgcacgatcatctcgtaattatagccagcttgataaatccgctcaacaatcttatcgaactcggcacgatcttcgataataaaggctttcttccgtccttcgaaatcaacagataaccaggcgacactatttgccggtttcaatgccacgggaaactcaaatggcagttcttgagtaaagcggccatcctctaatagatctggtgtcaaaataaaagtttttggataaggtaagccaaactcttcacacacttcatagaaactcactttattgattaatcgtttcaacaaagaataatcattcgcaataaatgtgtaatatgacgctaaatctgctttatgtttcgctaacaattcagcataaccatccccgcaaggaatcaacaaataagccatagagggatcgttataagtggtttttgccaaatcaatcaatgtatctaaaaaaccaggatcatgatcaaatcctgctacttgattgaccttgacgattttgctatagcgggtgggggcaagctgtgtcccagcataagcaattgactggatgccatatgcttcgtgaaaggctcttgccataccatagacattcatatcgcttcctaacaaaataggaacgaatttttccggattcataaaaccactctctcttttgcatatataaatttagatttttacctatttactttgttacaacagacctataataccataaagaaaaaagcaatcaaagtatgtacctctgattgccttcctcttctttgaacggatagaacttataggtcgtttattctgttacgaatagacatttacctattgctattttaacaaataaacggtgcattacaagagttatttgagaatttgcagaattattacagtaaatattaaattttgctaaaatcccctttatctccgcctttatcctacctctctcataagactttcttgaggtattttccggtatagctttcaggaactgctgctatctcttcaggtgtaccagttgcaaggatcgttcctccgccctcgccgccttctggacctaaatcaatcacatgatctgctgatttgatcacatcaagattatgctcgatcactagaactgtattccctgcatcaacaaaacgctccaagactttcaataaacgagcaatatcatccgtatgcaaaccagttgtaggttcatctaatatatagaagctttttccgtgagaatttttgtggagttcactggcaagtttcattcgctgtgcttccccacctgataaagtggttgccggttgccccatcgtgacataccctaaacctacatcaacgatcgtttgtaattttcgatggatcttaggaatatgtttgaagaattcgacagcatcttcgaccgtcatctcaaggatctctgctatattcttccctttgtaatgcacttcgagggtttctgaattgtatcgtttgccgtggcaaacctcacaaggaacatagacatccggcaagaaatgcatctcgatcttgatgatcccatctcctttacatgcctcacagcgaccgccgcggacattaaagctgaagcgaccttttttataaccgcggactttggcttcattggtttttgcaaacaaatcacgaatgtcgtcaaaaacacttgtataagttgccggattacttcgaggggttcgcccgatgggactttggtcaatgtcgattagcttttcgattgcttcatatccggttagtttcttatattttcccggtttgttcgaattgcggttgattttttgtgctaaagcttttttcaaaatttcattcactaatgttgattttcccgaaccagataccccagtcacagcaataaactttccaagagggaaatcaacgctgacatttttcaagttgttctcagctgcgccagtcaagcgaatggactgtccatttcctgctcgacgttctgccggcgttggaatctcccgttttcctgaaagatattgtccagtcagtgaatgttcattagccgcaacttcctctggggtccctgctgcaacgatctcgccgccagcatgtccagctcccggacccacatcaattaaataatcagcagaacgcatggtgtcttcatcatgttcgaccacaatcaatgtattgccaagatctctcattttacgcaatgaatccaataagcggtcattgtctctctgatgaagaccgatcgaaggttcatccaagatataaagcacaccagaaagattggaaccaatttgtgtcgctaagcgaatacgttgagcttcgcccccggacaaagtgccagaagcccgacttaaagtcaaataatccaatcccacattgcgcaaaaagcttaaccggtcatccacttctttgacgatcggttttgcgatcatcttttctggttcagagagcgttaatttttcgacaaatgataaggcgttgttaattgccatctcactaagttcaccaatatgcttgccattcactttgacggataatgcttgtgggtttagccggtagccatgacaggttttacaggtcaattctgtcatgtacagacgcatttgttcccgggtgaaatcactattggtttcatgatagcgacgtttgatattaggaagaattccttcaaagggtacttcaacgtcccgtacaccgccaaaatcattttcataatgaaaatggaacatttcgccattggaaccattcaaaataattgcttggtgttcttctggcaattcttcaaaaggcgtgtccatgtcaatattgaattccaagcaagcttgttccagcatttgtggataatattgtgaactaatgggattccaaggaacgattgcaccttcacgcaacgttttgctagtatcaggaatcactagatcagtatcaacttctaattttacccctaatccatcacaatccggacaagccccaaaaggtgcattgaaagaaaacaaacgtggttctaactcgcctactgtgaagccgcaataaggacaagaatagtgttcactaaacaacatctcttcttgaccaatcacatctactacagcgtagccatctgccaaacgtaatgcggcttcaaaagaatcaaacaatcgcgaacgaatgccctctttgacaacgatccggtcaatcacgatggcgatgtcgtgttttttatttttttccagttcaggcgcttcagaaacatcatagatttcaccgtctactcgaatcctcacatacccttctcgttgaatcatttcaaaaacttttttgtgctggcctttcttttgataaacgatcggtgccaacaactggatctttgtccgatctggcaatgccagtacttcgtcgaccatttgttccactgattgactagtgatctcaatatgatcattcgggcagatcgggtgtccaatacgggcgtacagcaaacgcagatagtcattgatctcggtcaccgtaccgaccgttgagcgaggattcttactcgtcgttttctgatcaatggagatcgctggactcagtccatcgatactatccacatctggcttatccatttgtcctagaaattgtcgtgcatatgcagacaagctttccacataccgccgctgtccttctgcataaagggtatcaaacgccaaagagctctttcctgaaccagacaaaccggtcacaacaaccagtttatctctaggaatcgtcacatcaatgttctttaaattgtgtgcgcgagcgccatggattacgattttatcatttgccattctcttgtctccttttactcagctgctttcaattccaagatcgtgtctcgtaaagtagctgcagtttcaaagtctaatgcttttgcggcatctttcatttctttttccagttttaataagagagttgctttctcttcacgagtcatgtcttcatacgaagtggttgtataatcgcctgactcttccgcaactttcgtaatagcgatcaaatcgcgaatttccttaatgatcgtttttggttcgatgccatgctctttattatacgcctcttggatactgcggcggcgacttgtttcatcaatcgctcgctgcatagagtcagtcattttatccgcatacatgatcactttaccatcagaattccgagcagctcgaccaattgtttggaccaaagaacgctcactacgcaagaatccttctttatccgcatctaagatcgctacgagagaaacttcaggaacgtcgatcccttctcgaagcagattgatcccgactaatacatcaaattcaccaagccgcaaatcgcgaatgatctctgtccgctcaagtgtcttgacgtcactgtgaagatatttgactttgattcctaactctttaaaataatcggtcagatcctctgccatttttttcgtcaatgtggtaacaaagacccgttgatctttttctacccgctcattgatttctcctacaagatcatcaatttgccccatgatcgggcgaacctctactactggatccaataaccctgttggacgaatgatctgttggataacggtatccgtttgttcatgctcgtaaggtcccggcgttgctgagacataaacgatctgattcacatgttcttcaaattcttctaaacgtaacggccggttatctaacgcagacggtaaacgaaagccataatccaccagcatttgtttgcgggcacggtcgccgttgtacatcccacgaatctggggcatcgttacgtgagactcgtcaatcacgatcaggaaatcatcaggaaagaagtccagcaacgtgtaaggtggttcgccttctttgcgcccatccatgtgtcgtgaatagttttcgatcccggatgtgtagcccatttcccgcaacatttcgatatcataattggtgcgttgctctaaacgttgtgcttccaataatttgttctcacttcgaagaacagctaatcgatcttcgagttctttttgtatcgaagcgatagcatgttccatatggtcttcgttggtcacaaagtgagtagctgggaaaatagaaacgtgttctgtttcccctaaaatctccccagtcaacgcatccacttctcgaattcgatcgatctcatcgccaaaaaactcgatgcgtaatgcccgttcgtcccgcgatgccggaaaaatttctaccacatctcctcgaacacgaaagcgtccccgttggaaatcgatatcattgcgttcaaattgtatgtcgatcatttctttcagtagttgatcccgcggtttttccattcctactcgtaaagaaaccacttgcttagcatattcgattggtgaacccaaaccaaaaatacaagagactgaagcaaccacgatcacatcgttgcgttccagtaatgaactggtcgccgagtgccgcagcttgtcgatctcatcattgatacttgaatctttctcaatgtaagtatcactggaaggtacatatgcttctggttgataatagtcataatagctgacaaaatattctactgcattattaggaaagaattccttgaactcaccgtataattgacccgccaatgttttgttgtgtgcgataatcagtgttggcttattgacctctttgatcaagtttgaaacagtataggttttccctgttccagttgcccccaacaaaatctgcgccttcttgcccccaacgacgccatcgaccaattgatggatggcttctggctgatctcctgccggctgatattttgagagtaattcaaattcatgggaagtcgttctttcgatcatcttcattccccctgtatttatatttgcgaagcgtccgtgaaacaaaaagaaagctgacgcttttccatagaatagtataccatagcgaacatactttcgccatcttttgtactttttattctgctagtttaactttacttaagatgtcagtttttctaacacccaatgtcagaaatagcgctgttttttgcaaatattgaccgaaagacttgtgtgtttttacaaaaatacctataatctaaaaatacgttaaaatcaaaagggggaattttcttgaaaagaaaatatatgttttgtgcactgttttcagtgattttctgctttttcgcttttgcgaacaagccagtcagtgcagcagaaacaacgtataaaatcggaacagacctgacatttgctcctttcgaatttcaaaacgaaaaaaatgagtatgtagggatcgacattgatctgttaaatgctattgctgaagatcaaggctttgctgttgatttgcgcccattaggctttgattcctcgttacagggcgtccaatccaatcaacttgatgggatgatcgctgggatgagtattacagacgaacggaaagaaacctttgatttttcagatccttacttcgacagtgggattcagatggctgtcgcaaaagacaaccaagatatcaaaacttacgctgatttgaaagataaaacagttggcgctaaagttggtaccgagagtgctcgttttctagaaaccaatcaaaaaaaatatggctactctatcaaaaactatgatgatgctagcgggctttatggtgccgttcgcaatggaacagttgtggccatctttgatggctatccagtcttaggttatgcgattagtaatggtgaagctatgaaacttgtgggtgagcctgaaaaaggggcatcttacgggttcgcagtcaaaaaaggccaaaattctgaattactggctaaattcaacgctggtctaaaagagttgaaatccagtggtaaatacgacgaaatcattgctacttatattgcttcatcagaaagcacttctgatgaagcaagtgaaatggttaaagttgaaccgaaaaaagacgtctatcgaatctcaagtgactctgcattcgcacctttcgagtttcaaaatgaagacaatgaatatgtcggaatcgatgttgatctcttaactagagcggcggaaatgcaaggattcaacattgagtttaatttcattggtttctcaggagcgctacaagcgttagatgggaatcaagcggatggtatgattgctgggatgagtatcaatgatgaacgcaaaaaagcgtatgacttctcagactcctactttgaaagtggtattcaaattgcggtcaaagaaggaaacgatagtatcaagtcttatgaagatttagaaggaaaaacagttggtgctaaagttggtaccgagagtgcagacttcttgattgaaaatgaagacaaatacggctataccattaagtattatgacgcagctgatcaactttatgctgcagtcagtggcggtcagatcgacgccatgatggatgattacccagtcattggctacgccatcagtcaaggacaaaaactaagtacgccgattgagaaagaagtgggcggacaatatgggtttgccgtcaaaaaaggccaaaatcctgaattgatccaaatgttcaatgaagcgttaaaagaaatgaaacgaactggcgaatacgatgaaatcgtcggccgttatatcaaagacggttcggctacagaaaagaaagccgatgaatcaacagtcgctggtttaatcaaaaacaattacaaagttttgctaaaaggtttatggaataccctgctgcttgcattgatctcctttgctttagcgttgatcattgggatcatcttgggactcttcagcgtgtccccaatccgagctttgcgtatcttcgccggtatctatgtcgatattattcgcgggataccaatgatggtgttagctttcttcattttctttggcctttcggatgcaattgggattacaatccccgactttgctgcaggagtcatcactttgacactgaacgctagtgcgtatatcgcagagatcgttcgcggagggatcaaagctgttcctgtaggccaaatggaagcttcccgcagtttgggattgacctatacccgaaccatgcaaaaaatcattttgccgcaagccatcaagatcatgatcccatctttcgtcaatcaattcgttatctcgctgaaagatacgacaatcatttcggttattggtgttgtggagctgctgcaaactggtaagatcattgtcgcaagaaccacacaaagtacctatgtttatctaatcgttgctgtcatgtatctaattgttatcacagccttaacaaaacttgctaaagttttagaaaagaaggtgaaataaatgaaggaaaaaatcttagtcgaaaatcttgtaaaaaaatatggggataacactgttttaaatgatatcaatgtctcgatccaagaaggcgaagtcgtttgtgttatcggtccttctggctcaggaaaatctactttcctgcgttgcttgaaccgtttagaagaacctactagtggtgatatcattatcgatggtgctcatctaatggataaaaacaccaatatcaatgccgtccgtcaacacataggcatggtttttcaacatttcaatctgtttcctcatctctctgtactagagaatattatcttagcaccgatggatttaaaaaagatgtctcgtaatgaagctgaatcaaaagccattcaattgctggacacagtgggtttggctgacaaaaaagacatgtatccagacaatctatctggtggtcaaaaacaacgggtagccatcgcccgtgcattagctatgaatcctgatgttatgctgtttgatgaacctacatctgcgttggaccctgaaatggtcggtgatgttttgaatgttatgaaaaaattggcaaaacaaggcatgacgatggttatcgttacccatgagatgggttttgctaaagaagtagccaatcgcgtcatgtttatcgatggcggaaatttcctagaagacggcacaccagaacaaattttcactagtccgaaaaacgaacggaccaaagactttttagacaaagtcttgaatatctaaacaaaatccgcagaaaacttggtcgttttctgcggattttgttattcatctgacattttagtttctcgttgctgctttttgtactgtgcttctaaagcgattcgtttctgcttttcaccaaaataaacttttgtatcgattggattggctttgttgaatcccccagcaccagtatccatcatttgcccccagcctttcagcggatcttttccttgtttccttaattcagcgttctttttacgcaattcttgtttcttcgcttctttcttttgctgccgctgctcctttatttccttaaaaaaactcatcccataccctcctttgatcaataaagaattgttccaatgactattaataacaaaacaacaactggatacatcaattctctgatccagtgtttttctttccaagcaagatacagcaaaccgccaatgatcagcaataaaatagtcggttcaaacaataagccaatcaaattacttgaataggttctggttgttagttgatcactccctgtgcttaacctaaaagaactgaaacgaaaaagaatgaaacgactgaaaacataacaagacaaaaacaccaatgaatacccttttgcaaaccaacggaatagtttgctaaatggaatttttttcaacaatactcattctccttccgtgattacatcttggaccatgatatctgagagctgctgcagctggactctcatgacaagcgaccgattctccgctaaccatcgagctaattcagtgcaagaggccgatacatgaacggcacttactttcacaccattatctttgacataatttagaatgtcgccgaaatcatagaaattgatttgattggtaagatcattggtaaaatggagattgtcaggactatcccagcctagatccccaaaagtcggataatatttttccaaaaaaaccagtccttgcgtgacgctttctgttacttgccgatcataatcatttcctgttgtctgacgaaccatttcatctgaataaccaaaaatattgtctgaatgataatcaatactataatgttgaacagacaaatcagccagtttttcccttagctcactaggaatttgaggattttttaaagtaatagaaatttcagcctgcttgtactcgccgagtgaacgtaaataggcgagaaaggagtcataggtcgaaaccgcattgcctggctcatatagtgttgcagagggagcaaatgcggtcagcgtatcgctggaaacaattgtctgaactgcctgatcaaaaatatagcgattttcgactgtgtacgcgaccgtcttctgatttcctaaacgagaaatgaccggataaacgtcctctttccccaaaaatgcaagcagagattgccgattgataggatcgtaatggaggtttcgctgtcccatctcataccaatagtagcggtacttctctaacgtatcattcttaagcgcatcttccgaatatagagcattcatcgccgaaggaatcgattgataatcctcgcggtcatttccggttgcacgataataggctaatggtaaaaagtagcataaaacaagcactaccatcccccaaaacaacacgctatagatcatttggagtaccatgcttttctttgtacgatccactgacttttgtaatcgctggtactgttttttatccatgtgaccacctgcttttcacttgttttctcgcttgaaaaacacgagatttcactgtacttaacgttagatttaatatttctgctatttcttgatagctatagccgcgaatcgccaatatcaaaggatgccttaatttgttaggcaattgattcacatgacggagcgcttcttctttttcaagactatcttggtcttcgataggaatctcctgcatcaaagtatcgacttcttccgctaccaaaagataccgcttacgacggtaaaaatcatatagtgtaaacttagcaatcgtaaagagccacctctcaaagtcatctggctttgtctttggcaaagccaaaaaaactttaacaaatacatcttgcgttaaatcctctgcttgatactcatcccccactcttttttgaaagtagtgctgaattttctcgtaatagatctgataaatctcctccaacactacccctccttacttatatagacgagtgaacaacaaaaaagttgcaaaaaaatattatagtaagaatagtatatcactgttactaacgtattcagaaggttctttctacgtaacaaaacaaaaaaagctgtaaaccacgctgaaatgtttcgtgtggcttacagctttttagaatggatttaagcaaagacggttgaccagttctcccgttcggctaaaaactcccttgccaattgttgggcgccttctaaggtatggttggctgcccagccgcattggacttcgttactagctggaacttctgtcgctttcaacacatcttccatcgttttttctaacacagttaaaatttcatcataatcttcatgatttaaaaccgttagataaaatcctgtttgacagcccatcggagaccagtcaacaatgtaatcggcatgattacgaatcaattctgcggtcaagtgctctaatgagtggaggctagccatctccatatgtgcttgattcggttgtttcaatcgaacatcatatttgataatcgtatcttttgttccttgttttttgtcagcgacccgtacataaggtgccttgactttcgtatgatctagattaaagctttccacgttcattttcattctttttctcctctcgcttcgacgagccaaacaaaagcattgatttgtttaaagcgactggtaaaaccattggctcgaaaataggtttcaatatctggtatcaatgggtagtattctcgttgcagatccgctgctaatcgtaagtgattggctttgattgcctgtcttaggatgctttctttatgctcaggggataaaaacatcgtatcccctataatgacttttccgccttcagaaagcagcgctttatatcttttaatcactcgctgtttctctgtttcattcaagtgatgaaagacataactagaaacgatcgtatcgattggaaaattgatctgtggaaattgttccatatctccatcaataaaagttacctgtgacaactccggctttgcctcagctacttgacgcatcgcagccgatggctcgatcgcgaacactgttttctttcttcgaatcaactccaacgtcaaatttcccgtaccactaccaaattctatcacagaatctcctgctttttcagcaatatttgctaacaattctggataatgaagaaaaacctcccgatattcttcatccttccctttgacggtctcgtcatattgcttggcccactcagaaaaaatcggaatgaattcacgccccatcttccagcaccctttctaatccttgctttaagtccgtccataaatcggcagcgtcttcaatgccaatagacaaacggatcaagccatctttgattcccgctttttctctgattgaaggtggaattgaagcatgcgtcatgaccgcaggaacttcaactaaactttcaacgccacctaagctttcagctagtgtaaaaatagttagcgattcaacaaacgcagctactcggttttcggcttttaattcaaatgaaatcatcccgctaaaaccagacatttgttttttggcgatctcatgtcctttatggcttgataaccccggataataaactctagctacagctgcatgttcttgaagcaatgtggcgatttttagtgcattggcttgatgggcttccatcctcaaagccaatgttttgatgctccgctgaactagccagctgtcatgaggccctaacacaccacctatagcattttgcagaaaaccaatttgctcagctagttccgcttgattggttacgactaacccagcaacgacatcactatggccccccagatatttcgttgcactatgaatgacaatatcggcacctaatgccagtggacgctgaaaataaggtgtcgcaaatgtgttatcaacgatggtcaagagatcctttttcttagcaatcgtggcaacttgttgaatatctgtgattttcaacaaaggattagtaggcgtctccagaaagattcctcttgtttctggccgaatcgctgcggcaatccgctgaatcgcttggggatcatcagtcttgaccaatgtatacgtcaatccattctttttgaagattttctgaagcagtcgaaaggtgcctccatagacatcatctcccaacaaaatatggtctccggactgaaataaagaaaaaatagtatgggttgctgctaaacctgaagcaaaagcaaacccacgtatgccttcttccagttcagcaatcagttcttctaatgcaaaccgtgtaggattgcccgaacgagagtactcatattgttttggctgtcccacagctacttgcttgtaggtagacgtttgatagataggtacactgacagcccccgtttcttgatcttgactgatcccagcatgaatcaattttgtgcgaaattccatgtttatgcctcctctagttgaccataaatattttttgacaagtagcgatctccactgtcaggaaagatagtgacgatcgtgcttccctttggcagtcgcttgctttctcggatagcggctgcaaatgctgcaccgctggaactgcctaccaatagaccatgacgggctgccagcaaccgggtataataaaatccctctggatcactgatagtctcaatgctgtctggcataagactcttaaaaaagatcggcctctcttcaacgcctatcccctcgatcgcatgttcatgagcaggcccgccattcaagatcgatccctctggttccacagcaatcaaacgtatagtagaatctatcgactttaaatacgcacctgtcccggcgaaagtcccgccactccccactcctgctacaaaactgtcaattctctcaggaatttcttgaacgatttccggacctagtgttcgataataggcagccggattttgttcattttcaaactgtagcggcaaaaaagagtttggcaattgatcagcaagaaatttggctttcctgattgccccttgcatgccttcttgactaggcgagtgaatgattcgtgctcctaaggctttgattagttgttgcttttcttgactgaatgtatctggaatcacaaaaagcatgtctaatccatatgccaaaccggctaaagctaagccaatcccagtattgccagcggtgggttcaatcacggttgtgtctttcgttattcttccagcagcaactgcttctgagatcaaataactgcctaatcggtctttgatactacctccagggtttaagtattctaatttcgcatagatccggctttggctttctccgccgtagtcagtggctaaaaactgaaaaatcggtgtcttaccaattaattctttaatatctgatacgatcatgggcaaccttcttttcaatgaaatttttgttgtcagtccgctaaagtgctgcagcaaatcagaggcactgcgttttacaattggtcattcctaggtgatcacctgcttaaaaaggcatgatctgtctttgtttacagatctttgcaaggtaaatcaaagcaaacaaaaagaggcactgactattcaatcagtacctcttagagaatgactctaggactctttcccaacgaaagagactcttagagtgatttatccagatgagggaacgattaataggcatgacaaatcagtatgctgctttttagcaccatacaacaacaacataccaatgcaaagttgttgtttgtcatgtctacgtcccctcctttttaagcttgtaaacaaaatagcatgggaaaaaatagaagtcaatctttttttctttgtgaaaaatttttggtgacatatgcatcgacagcctgaaatgcatttgctacctcttctgctgtgatcttaaagggcattcgatggatcgtttcattagggagagtggcttgaataccgattgctagtaattcctgatcgttaagtgagtccatctgcatttctgctaacgttgttggtaaccccagagcttgatataaaacaatataacgttccaactcgtttgtatcttgttccaacagcaattgcatcaacgtcgtataggcaattttttctccgtgagaaagttggtggaacttcccagtagcggctgtcaacccattatggatcgcatgagctgctgctagtcctccactttcaaatcctagtccgctcaaaagtgtattcgcctccactacttgatcgaaagcggctgttacctgttgctgctgattggccttataggcagcgaccccattggcaaacagcactgcttcacatttctcagcaattgccatagctgctaaagtcggccgtcctcctacaagattctgagcgccgcttttagctactgctctggcttcaacatacgtcgccaatccatcggcgatgccgaaagttaataattttgcaggggccttggctaacagagttgtatcaaccaagaccagttctggattcttcggataataactatactgttcaaatttcccttctttcgaataaagaaccgagatggaggaggtaggggcatctgttgaggcaactgttggtacgacagcaaccgctcgcttcaaatgatgggccactgctttaccggtatcgatcacctttccgccaccaagagcaacaactgctgccgcttctgctctttctgcttcttttgcaatacgtctgatttctgcattggaggattcaccgctgaaatttgctaaggttacttcgattcctagatgggctaaatcgcttgccagttcttcgccagcaatcctccaaacaaatggatcggttattagtaataatttatctcctaatgagctaatatagtgcaagccttttttaatacgttttctccttgaatgtagcgctgcagactaacaaatattttttccatgaactctcctactttcatttttttataccaattcccgacattgttaaaattttcacaaacgctagtaaaagcgcagcctgaaaaagtggttttcttcaggctccgctttttattttttcttaccaccaaaggcatctttcattttatcaaaaaatccttcaggttgttgctcattggttacatggccgcttgcttttgcataagcccgtaacgcttctttttgttcttcattcaaattctttggtgtgatcaacttaactttgacttgttggtcaccattgccattgccacgtaattttggtgcacctttgcctcttagacggaaattcgtgcccgtctgggtaccagcaggaatcttcaatttgacatttccgtgaacagtcggaacattgacctcgtcacctaaagctgcttgaacaaagttcaatggtaattcgtaataaatttcggatccatcacgatcgaagatatcactttcctcaacacggaaaacgacatacaggtctccataaggtccgccattgctgccagcttctccttgaccggataggcgcatttgttgaccatcttccacgccagcgggtacattgactttgacgctatgttttttcttttcgtgtcctgtgccatgacaagtcatacaaggttctttgatttctttccctgtaccgtgacatacatcacaggtttgacggctcatgacacgaccaagaggtgtttgacgttccacattgatcgtacctgagccatgacatttatgacaggtttcaggttgtgttcctggttttgcgccattaccgccacaagtatgacaggtttcttcgcggttatactgaatatttttttccacaccaaaaatcgcttcttcgaaagaaagatccacagcatattgcaaatcagctccttgtcgcggagcatttggatttgccgttctgccaccgccgccaaagaatgattcaaagatgtcttcaaatccaccaaagccgccaccggagaatcccccgccgttaaagccgccaaagccgccgccataaccaccaccgtagttcggatcagttcccgcgtgaccatattgatcgtaagcagctcgtttttgaggatcgctcagtatttcatatgcttcagaaatttctttgaattttgcttctgcatcaggttctttattgatgtctggatgatactttttggaaagcttccgatatgctttttttatttcgtcatccgaagcccctttttgtagacctaagacctcataataatctcttttgtctgccattggcttccctccactattttcttgcgtccctcgtattttagcatataatttgcttcagaaaaatacgtttcagaaattcataagaaaaagccaaagtggtgactttggctttttcacaaacagcgattatttatcgtcgccgtctacttcttcaaaatcggcgtctaccacatcgtctgcgccgccttgtgcagcttctggattttcttgtgcttgttgttgtgcagcttgctcatacaacttcactgtcaagttttgtacgatttcattcaatgcatcgcgttttgttttcatttcttcgatattgtttgcatcgacagcagctttcaactcatcacgagcttcttccgctttcttcacttcatcggcatctaccttgccttcaagctctttcaatgttttgtcaacagtgaatagtaatgcgtcgacatcattacgcaaatcaacttcttctttacgttgtttgtctgcttccgcatttgcttccgcatctttaaccatccgttcaatttcttcatcggttagacctgaagaagatttgatcgtgattttttgttctttttgagttcctaaatcttttgcagatacatttacgataccatttttatcaatatcaaatgttacttcgatttgtggaattcctcgaggtgctggtggaatttccgttaattggaatcttcctaatgtcttgttgtcagcagccattggacgttcgccttgtaggacatggatgtctacagcaggttgattgtctgcagctgttgagaagacttgtgacttgcttgttgggatcgtcgtattgcgatcaatcaacttcgtaaagacgccgcccattgtttcgatacccaatgataatggtgtgacatcaagtaaaacgacatctttcacatcaccagtgatcacgccaccttgaatcgcagcacccattgctactacttcatctgggttcactgatttgtttggttctttattggtttctttgcgaactgcttcgacgactgcaggaatccgagttgatccaccgactaagatcacttcatcgatttcagattgtgaaagaccagcatcttttagcgcttgacgtacaggaacttttgtccgttcgactaaatcagcggttaattcatcaaattttgcccgtgtcaatgtcatttctaagtgcaatggaccagcatcgccagctgtaataaatggcaagctgatttgtgtacttgtcacacctgaaaggtcttttttcgctttttcagcagcatctttcagacgttgcaatgccattttgtctttacctaaatcaatgccattttcttttttgaattctgcaaccatgtgatcgataatcttgttatcaaagtcatctccacctagattgttgtccccagcagtagacaacacatcgaatacgccatcccctaattcaaggatcgatacgtcaaatgtacccccaccaaggtcgaagactaggattttttcgtctttgtctgttttgtctaatccataagctaaagctgctgctgttggttcgttgacgattcgttctacttctaatccggcaattttaccagcatcttttgttgcttgacgttgtgcatcattgaagtaagcaggaacagtgataactgctttgtctactttttctcctagataatcttcagcaaatcctttgatatattgtaggaccattgcagagatttcttgaggagtgtatgatttcccttcaacttctactttatagccagcttcacccatatgacgtttgattgatgaaatcgtgttagggttcgtaactgcttgacgtttagcaacttcccctacttggatctcgccgtttttaaatgaaacaacagatggtgttgtacgatttccttctggattggtgatgatttttgcttcgccgccttctaggacagcaacagctgaattagttgtacctaagtcaataccgataattttactcataagtaatacgctccttttcattcatcgttctttttatttattgtgctacgataaccatacttgcacgcaagacacgatcatgcagcttatagcccttttgcaatactgtgacgatcgtatccgcaggcacatcttctgtcgcaggtacggtctgtaccgcttgatgaagattgggatcgaaagtttctccttcagcaggaatttcttcgattccttcttctttcaacgcttgacgcaaactttccaacaccatttcgacaccttttttcaagttagccgcttggtcttcttccacatttgctgccatagcgcgttccaaattatcgatcgctggcaataattttttgcccaaatcttgcgaacggtatttttgcaacaattcacgttcattacggtttcttgctgtaatattagcgatttcggcccgtgcgcgcagaaattggtcttctagttcattgtttttttcttttaaactgtcgatctcgcttttttctacttctgcttctgatagaccagctgcatcgatttcttcttctgacggttctgtcagaggctcttcagttgtctcaagatctttttctacctgttcttctttttctgacacttgctaccatcccttctataattcacttatttgatcattcactgtttgcatctagtgtgcgatagtaatcagccaatgtcattgctaattctcgacgaaaggcatccatcagtccaaacattcgcgaataaggcatactagaaggacctaataaagcaatcgtcccttggccatgaccttcaatgtcatagcttgcttgaatcaaactcatattttggagtaattcattccctagttcctgaccaatgcggatctgaatcgtggagtctctcggtgccaataattgtgtgagttcttctgcatttttcatgaaagagtacatcgacttaaactgacgaacatcttgacttggttcaaaatctaatagattcatccgtccgccgacgtaaattttctcttcaaagagatgactcaacatatcatcgaataaatcaatgattccttctgttgtttgaaaatacttgtgcaaaatcatcggaatctctgttcgcaatcgatgatagaccgtcatgagcggttcacccactaatttttcattgataatccgaaccatcttttctaaatcgctgctatccatcgatgaaggtaatgaaaaaatctgattttcaacattgcctttatccgtaacaatgatagcaataatttgtcgtgcattcaaaggtacgatccgaaagccagtcaatttccgttctttgacatccggtcctaacgataatgcggtatagctcgtaagattggataggatcgtagcagattgctgaatgatttcattgatttcatgaaattctttccccaaggaatggcgaattgctttgatctcattttgattgacttttgatggtcttaataagtgatcaacgtaatagcggtagccggccattgaaggaacacgtccagaagaggaatgtgtcttcaataagagacccgcttcttctaaggccttcatctcattgcggatggtagccgaacttgcttcaaccccatcctccatcaatcgtttggagcccgtaggctgaccagtatccgtataattttggatgatgaggtgtaaaatagtttgttgtcgttgtgtcaacatcttatccactcctccgttagcactctttcacattaagtgctaacacgattattaatataccatatttcctacgaatgtcaagaatttgacacagatttttagcactcttatagagagagtgctaatccacttcattgtcaattagctccaaaaaaagaagatcgaaaacagctcgatcttcttggttattcttaacttaataaaaatttttcaaatacatcattgccgataaacatcccagactttgttaaataaacgcggtctccttctgagactaaccagccatttttagaaagttcttcaacgacattgccatagatcgaatcaaaagaacaggcaaatttatttgaaaaggctgttttcgatacaccttgtttcttccgtaatccaagaaacatttcttcttccatttgattgctggtcgttaacgattctgtttcatggatcggcagttgatcttccctcaatggacgcagatagtgctggatcggtccaaagtttttgtatctcgtctgtccgatataaccactcgctcctgcgccaaatccgtaataatgttcattattccaataaacaagattgtgcttagactcatatcctggccgggaaaaattactgatctcatattgcgataagccagctttagccattgcagtgatggcttcttcaaacatttgtgtctcagattcctgagaaggcaactccattttcccttgcctaacccaattcatgaacatcgttttgttctctaaaatcagtgaatacatagcatagtgaggcaaacccaaatcaatcgctcgtgttagcgtatctcgaaaactttccatcgtttgtccaggtaaagcataaatcagatcgatcgtaatattttgaaaatcatgtttatctaacaaccgaatcgtttgatagacatcctctgccgtgtgcttgcggccgattttctttaacaagcggttatcaaaagtctgcacccccatcgacaaccgatcaatgcccagatttttcaaaactagcaatttatcttccgttaaatccccaggattggcctctaccgtaaattctttggtcgtttgcgtgggcagtaattcatgtatgcctgtaatcagaaggtctagctgcgcagccgaaagggaagtcggcgttccgccgccaatataaatcgtctcacaagtagtgattggttgtttgctcaccgttagagcgatttctttcagcaaacactcgatgtattcatcaaccggttgcccttctaaaaaaactttattaaagtcacagtaataacaaatatgttcacagaatgggatgtgaatataggcagaagtactggtgggaagtgtattgattggaatcttattcatggtttgcatatttttattcctttcagagatcaaatcaacgttcaactgcacaaatacggctcgcagcaaatgaacctgatccgaggtatatccgctccccattctatcataagtaagattatctcgaaacgcctctgcattaaaagtagttagaagcagatctcactgctatccgttaataagaatacaatcgcatgcgcaaaattttaaaatcttcaccgataaatgggaaataggcttcatccccattcaggcgacgatttgtccgccattgcccatcttgtagacccccctcttctaaagaaaggatacctaaaggattagaaccctgctgcgcttgcagatccaatgcgaaattagcaccggtgagatagtaatattctttgtgtttaatgatcagacctgcggaattgatcattttgtctcgagaaaataatttgactgcccagcgatcctgaccattttcatacacaatttggttctgagccccttcttttttaaatgagaagatttgagcttcctgatcttgcaacagtggctcaagggcggcgatgattcgatacccttggtttaaatgaggcagtgtatcggaagaatcaaaggcgtctttcgctaatcctaactgggataaaaagcggtaatcctgactagtatcatccgttagaagatcttcgataccaaaaggtgaatagccgattgctccttgaccaaaagcataaaatagattcgaaatatatcttttgtcaattcgggtttccggaattaacaacggctgatcattcccgtattccgcgatgatcggtttgatttcttcttcgtaaatatctggggcaataaaatccaactgagaggcaataactttccaaacttgccaagtggtggatacagcgccaccactaggatattctcccggccgcctgtctggctttttgagccatacattcgtaaataacggcaacgctaaacgttttcttgcaatctttgcatagtcttggattgctgcggcataatgatatgccataaacacttcatccccaaagggtacttctgaccattgtttagctccgggatagaggtttctgatttcttgcggcaacgccatctgatagactttttctgctgctgacgaatgatcacgactagtgccaagactaccaatctcgttttcaatctgcaccattctgataaaggcccgcaaaggatggcttcccaagtagtcgcagatggcggcaaaggctgaatgagcctgtgctatcacatcttgacatagcggactataactattcatcttgtttccgtcgctatcctctatgcgaaaatatttaggatccgttttgatccattcaggaacatacgtggataagccattcttccaaaggccaaaccacaaaaaaatcacatcgattttcttctcagcggcattttccaaatgggaatcaattaatgaaaaatcaaactgattaggctgtggttcgatcagctcccaataaataggtatcaaaagggtattgatcgcaactttgtcaatcttgtcccatactttttcctccatgtaagcgatagaggaagcagtggagttatggacttctcctcctagtatcaatttttgagaatgctgtcgttgtttcatcattgtcctcctttttcttctcagacagatagtcacgttttgatcgactatccctctcaggtagttgcaagcgtttttagtcgtaattctattataggaatcttctaaaataaggtatactaaaaaaagagaattcatactaaaaaaacagaaatgaggtttttgatgaatcgagcagcactagaatcaattgtgaaaaaactctacgataaatatttgattcctttatttatcttcgatgaaaaacagcaagtggtgattcctcgtaattccttcataactgataaacaagtggcggaacattttttccttaccagccaatcgactgaattggatgtggtgacgttttttgaaggagatgacttttttttcagcagctttacttgtgatctaccagattcttcaattggcaatgtgctgattggaccttgcgggatattaggtactaacaaaagatcatttccttttcaaggatatgattacattgctggggtccattactcgaaagaaagtcgagaatcttttgtcgctttcgttgaattgttttacacgatcctaaaaggagccatccctgatgccaacaagtttcgttggagcgttccagagaaacaagcaaattccaatacgtccaccctattagaagaaaatctttatcaacgacggttagaggatccttatttggactcgtttgaatttgagaaacgttacgtagaggctgtacgccgaaatcaacccgaaaaaattctttggctattccataaaatgagcagcacctacagcgtcgaactagcaaacaacaagctagaaagtttgaaatacaagtattcaggattgattaccattctaactcgggtcagtatcaatgaaggcgttccggtgagtcaagcctatgggttatccgatacactactccaaaaactacaaaatatttatgacgttcaggaatgtttgacccatattcaggaaagtacttatcatttcatgaggttgattcatgcatttcctacccagaaaagttttttgatcagaagtctcatcaattacattgatacgcatatttacgataaaattacattaaacgatttggctgaatttactgaaaaacaccccacccatctgagcacagaattcaaaaaacatgtaggccaaacgatccacacctatatcaatcagcagaaagtagcggaagcaaagcatttgttagtgtttactgattatagctataaagaaatagctgcattgcttcatttttcgaatcaaagccactttatccaagtattcaagcaatttgcgatcatttctcctaaagaatatcgcaaaaactatttctcaagtgtcttttgttcaactgatagttgatggatcaacttataaattctctctaaacaaggttgttaaccgtctttttctgccctccataaaaaaaggagtggatttctccactccttaaaagactcatgttttgggttaactactgctcacagtaattttttgctaacaacgacttatttaactaggtctgaccttcgcatgctatagtgagaaaaaaagctcttcaggctatacgttttcctatcattgaataaacatccgcaagagcgaaatcagataacgaatcaatcgatagatcaaaaacaagaaaaacaggttacctaaaataaagcggaagccatttccaatggaggcacgaaacgagcggaaactaaagtaacgggaccatttgctaaaagtagtttgtccatttcttctaatgcgataggcttcatcataagtattctccaacatatcatagtaaaagataaaaagaggttgtttagggaaaaatgcttttttgaatcctgccatcaacgtgtacgttttattagcagacggaaaattccgattgccgtttttcttgattcgcacttgctgcccgtttttatttttggcagcataataatcttcaaattctacgatttgataaatgatcggttcgctattttcttgttcaaattcagcaattatttgatcgacttcttgccaacgtagataaagccaagcaaacaacacgagcaaaacagcaatcaaaaacaaatttagtagaaatccctcttggatcagcgctagataagcacaaataatcaaaagagcgattccaacaacaatcattcttcgttggaaataactgcgatacatttgttcaaaagatcgccgataataggcaaagtcatcttttacaaaattcatgatcgtcccactttctgaaaagattatttggttcaatttatcaatatcttgtgaaaatgtcaatttatctctcgagtgatcttttttttatttaaatagaatcatttctcttgacttcttataggctactcgggttaaagtaatagataggaaaacgcttttaaaaaaatagaaagttgggaaactatgagtctactgaatgaaacattcacactgaagaatcaaatcaaaatacctaagatcggattgggcacttggcagtcctctccggaagatgcctatcatgcgacaaaatttgctcttgaaaacggctatcgtcatgtggatactgctgctgcctataaaaacgaagcggctgtgggcaaagccctccgagattctggtgttcctcgagaagagatattcgttacgacaaaaattcctgctgaactgaagtcatttcaagaagctgtcgatagcatcaaacgctcaatggcagagcttgacactgagtatatcgatcttgttttgatccatgctccacgaccttggaaaatcatgcgggataatccggagcaaaaaaaatatttcgaagaaaacattgatgtctggaaagcactggaagaagcgtatcaaagtggtttgatcaaatcgattggtgtttccaattttgaccaagatgacctgcaaaatatttttgaccattgcgatgtgaaaccaatggtcaatcaaatcatttatcatattggaaaaacaaatgaagagttgctgcaattctgtaaagacaacgaccttttagtggaaggttattcaccaatcgcgactggtcgcttgctggataatgccgacatcaagaaaattgccgagaactatcaacgctcgatccctcaattatctattcgttatctattgcaaaaggacattttaccattgccaaaatccgttcacgaagaatatattttggataatgcaaaagttgattttaccatttccgatgaagatatggcctttttagatcaactctaaacgtccctaacgcaaaaaatcgctcacctgcaaaatgatcaacttgcaggtgagcctttttacggttgttttatactaattgttcaaaggttccccagactttcacgttttttttatcgaccatcgcttttcctttagcgatcaccgtttcaacatctagcgtatcttgattcaacaggcaaagatcggcatccattccaggagcgatccggcctttttgagccaacttcaaaatctttgctggattagaagtaattgcacgcaatgcaatctccaaaggaatctgttctacttgtacagcttctttgattcctaccaataaagctcgggaactgcctaccccaagcccaatgaattgattgttttcatcaaagtaaggcagacttccttgaccatccgatgtcatggtgaattgatccaacccgataccttcgtctaacaaacgttttagccctttactaaagcgaacttcatcatcttctctttcccaaaaatcaggatcttcacttgcggtaaaatcgatggtaccgcccattttagcaaaagcgatacttgcttcaaacaactcacttgtccgatttgcatgagtcggtaaaaattgactaatagggatctcagtctcctccacagtttgtagcaagagttcgtattgtcgcttgccaccacctaaatgcacattggtgatccctgcttttcctgagagcatgccccctactcgagcatctgctacagcacgagtaaattcttcaaaactaggttgtgaagaacggtgatctgagaccgcaatttcaccaatgccaatcactttgtcgatcgtcaaaaagtccttgatcaatgaatccgtcactggatcaagaggcaatcgatacgaaccgtcatagacataagtcgagattccttccgcttctaaacctttggctttgctgatcaatgccaccatatcacgcccaacaccatcggttcctaaacagccgacaaccgttgtgactccagcagttgtcagctggctaagggttacttcaggcgttcggttctggtagcccccttccccgccaccacctaagatatggaaatggcaatcgatgaatcctggtgtcgcaatcaatgaagaaccatcgatttcttcgacagttagttgatcaaagccgccactgatttgatcttcgatggcaacaattttgtcattgatcactaaaatatctttctttcctaaatattctggtgcataaacttccgcttgacgaataagtttcattctcgcagctcctctcttattgcagaccaatcgctacagcgataaagataaagatcgtacctaacacaaacagaaatccttgcattttaatttggaacttcgcccattttgcccattcgattcgggcaacgccaagcacaccgatcaaactggcagatactggagtgaatgcatccatgaatccggaacctaattgataagctaaaacggcgatctgtctggagacacccacaagatcagctaatggcgccatgatcggcattgtcaatgctgcttgacctgagttcgaagtaacaactaaattaaataagctttggaaaatatacatgaaccaagcaccgataaaggctggcacaccgcttagcaatccgccgatgctgtgtaggatcgtattcaacgctgaaggcacattggcatcagaaccacctagaacaagcaggattccttttgccatcccaacaacaatcgctgttccggccaaatcagctgcacctgattgaaaagcacttgctacatcattcaagcccatgtcttctaacttaaagatcacagcaatcaggcctgcacctaagcccatcacgaagaactgtgaagcaatttctggaatatagtaccctttttgtgttactccccagacgatccaaatcaaaactgccagcatttcaagcaaaatcagtttatgccccaaaagaaacggcttgttttcatcagatgtcttctggatatggtcgcggaaataggcatccgatttgtaagtcaatgatttctccggattcttacgaatacgttctgcatacaccatcaaatatgcagctgataagccagtaatgactacccacatgataattcggaaagttgcccctgaaagaactgggatacccgcgatcccttgcgcaaccgccacactaaacggactcatccaagaagttgcatttccgatttgcgaggccacataggtgaccgttaccgccacgatcgaatcatacccaagtgcgatcacaaatggcaccatgaccatagaaaaaggaattacttcttccgccatcccaaaagttgctcctccaaatgaaaaagcaaagaataaaagcggtaaagccaatcgttctaatcctcgtgtcttactgataaaggcaaaaatcccagcatcaatcgctccggtcttcataatgatcccaaatgcgccaccgactactaagatcaacgcagcgatcccgacagcggaaccatatttatctcctgaaaccaatccttcaaacacaaagttcaagaaaccaaaaccgccaaaatcatctgttccccaaacctttgctgtcttatgaagtttttctgatgtatcatagattttatctccatataactcataaagaacatcatccgttagggagagctcatcgagcttttcttgatcaagtttcgactccccttcgtctagcacactttgcagtgctgcttgatcgacacccaattcttctagctctgctggattttcttctaaattctctaactgctcgaagacaaaatcggtattaagcggatacgcataacggaatgaatcttgtttcaaaaccgttcgcgtgctcacttcaccatttgcatcaacatattcaatctcttccgtactgaattttccggcaggaatcagaaatgtcaatacccatgctaccagcactacgccaaaaatgatcacatacgtgtgtggcgttttcatttttgttaaatcttttttctttttcaccaattttctccctttcaccttatacattgactgcataaattatcatttcccatcttttttagtatagcggaattttgccctttactcattgggaaaccattagaatttgttgtaaattctagcgaaataagctaggagaacactgatgtaccaaacaagtaatagacaagaaaaagtcttcaagacagtaaaatatcttgaagacttttaggtgatgcatcttctatttattcacacgttttgcgatcattggtaaaatcagtccaatcaagataaagatgatcggtgtgatgatattcaatgacaattggaacaaccaagcttttggatcagcagcataatctaattttggtaccatccctaagatacaagcaaatgctgtaaataagaaacaccacaaaccaataccaaagcctagttttgtatttttaacaaacttataatctgatgagaatcgatgggcttgtttattgatcagcatgaaggctacaaatacccataagtaacgtaatggcatcacaaccgaattcaagttcaacaaccagcgatacaattcagtcatatttccgatacctaacgcaggaatgatgatcaagatgctgactaagatccctgtcatgatatatccattgatcggtgtaccttttttgttcaattttgccaaaccatttggtacaaattctggatctgcatcagaaagcaaaattttcaacggcgcatcaatagaaaatgctaatgctgaaatttgcgctaatgcattggcgatcgaataaagaatcacaaatgtattgccaatcccatagaaattgccaagacgttggaatgcttcataagcgccatttaccatcaaatctttaggaatattgtttgcatcgaacagcatccccattgcgattgatcctagtaacgcacataaagcgaccattccggctaaaaagatcattcctttaggaaattctttggcagggtttttcgtgttattaacgtaaggcgaaattttttcacagccacctaccgcaaacaccagcatcgaaatcgtcgttaagtaagtaaaatcgaatttaggaatataagttgaaacagttgtcatatttggtgttgctacttgagctccagtcatcgctggtgctgttactgctaaaataataaataagatcgacatgacaaacatcgctgttccggcaatattaccgatcatcttcaatgtagtcaatcctttagatgcgatccataaaaagaaaagaaaaatagctaaacaaattaatgagacttccattgatccgacagtcgatacgaaagagccgtttcctttaaataaccaactcaatgataccaggatcccttgtggtttttgtgcgagatatgggacgtgaacgacccagtaagtccaagcagcgaaaaaggccaatcgtttggttgaagtttctttgatccaagaggatacaccaccgcttgattccttgaacgttgatcctagttgacctacactcaatgcgtagggaacaaagtataatgccatgatcaagatccaagatacaacaacagtcaatccctgttgtgcatagttgttcactacatttccgagtccccaaacagagacaaacgccattagcgcaatattataccagcgcaattgtttctcgttcattactttctcctttaaacatatgatttcagtgatcgaaccgaattctcgaatgatcatgatttccatgtatcgagcaaagtttatttgtaagtcgaatgagctgtccacaacgctttttcacttctaacgaacttctcgataactgtcattaacattgaccagaaatggaatagaatatcattttttttgaccattcatttcgtttcagtcatcacctcattttagaataaaccccaaaattattttggtcaagagaaaataataacaattttcatcgttttttaacaatgggttaagcgatatataaataacgagataaaaaccattatttagattaaaataactcctattgcgttccgttcctttactggaaattagcacctaaacaaattttttagaaaaaagataaaacagaattttggaatttttcagacttttaactattaatgattagaaaaataattttattcacgcaagatattcccttacaccactcttcccgctaaacaaagtgaacagtaatagaaaaaaaccaacttatattttgtctagactacaataaaaacgataacattcgtcataaaactattttaactattatttaaaataacaaaaaatcttaattagatcagtttgattgacactttccgatcctcttaagattttttacgagtactaaaggtagctcttatttatcgaagtatttcctagtatcaatctcgtcttgttgcagttgttcaatcaaggcttctgcgccactaaaagcaacttgatctctcaaaaagtggtgccagcgaatcgcaacagtctctccatagatatcttgatggaaatctaaaatatagatctccactgttaattgtcggccttgaccaaaggtatcattatgaccaatcgatcccatagacggataccagcgatcacctactttaagctcggtaacatagacaccttcttttggcaggcgcactgtacttttgactttaatattcgctgtcggaaagccaagttcgcgtcccctggcatcgccatgtacgacagttccttcaaactcataaggataacctaacagtcgattggcttctgccatttctccgttctgcaaagcggcgcggattcttgttgagctgactttctcccctgccaaagtttccttgggaacggtaatcacttcaaaacggccttgggcataagaaggtaaaagtgccatgtttgctgtctctttctttccataggtataatcgaatccagccacgaccacttccgcatgtaaacctaccatgtattgatcgacaaagacttgcggcgctaaatttgcaaaagctgaagtgaaatccacttcgtaaagatagtcgactcctaaatcagccatatgggcttctttttgtgataagctggttagatattgcattgcctcaggatccactttttgaaagacaatagatggatgctgattgaatgtcatcaatgccagcttcaatcctttttcttttgctgctgcttttcctgtttcaataactttttgatgacctagatgcacaccgtcaaaaaagcctagaaccaaaacgacaggttctgatggaatgacatctttattatatggatgacgtagctcgataatttccattcttactctcctatttctgtacgaataactttcgcaggttttaatagcccctgtttcctttgatgcggcatatagatactaacgactttatcttgataaaacaatgccacaggtgttgcaggaggttcttgaagaccaaaactatgatatggcaagggcatgccattcttgacattctgccacaacttctcatcaattgcaattttgggaaacccgcttaccccatattcaatgggctgcagcaacttattgattcgccctgattccaatgcttcacgaacttctgcaagcgtaacagattgatctttggtaaagccgccgcttgctaaccgtgtcaagtcagacatatgagaggctactcccaaagcagcacccgtatcgacggctaacgtacggacatacgttcctttcccacagcttacttgaaaccgccacgattgggtgccacttgtctcatcaaagattagatcgctgatccgcttaaatgaatgaatcaaagcttgccgttttggacgctgcacttcttcatttgcccgggcatattcatacaaacgtttcccattgactttaactgcggaatacattggcggaatttgggtaatttcaccagtcaaacttgccattgcacgatcgacttctgctgtagtaaaaggttttgctaaaggcgtcctttcaacaacttcacccgaacggtcttcggtcgttgtggaaaaacctagcgtgatttctcctgtatatatctttccggaatccaccaagtattccacgactttggttcctttgccaatgcagatcggcaatacaccgtctacatcaggatccagggttccactgtgtccgaccttttttgtatgtaaaatttttcgtagtttaaagacacagtcgtgactggtttgaccacggtctttccataatggcaaaattccatccatagtatccctccgcttctttttcaacttgaccattataccatattctaaaaaaacttagtatggtcttaaagtctttcagaatgatattcgttcatgatacacttatattataaggaggtgccacatgattgtattcgtttgttcattgattggtttcatactttttttatatttggttcaacgtggtacgctgcaacaacaagaggaggcactggctttatttgttatcaagagccgaacacctgctttaacacggatgatgctcttttttacaaatttcggtaaagcattgcccacgatcatcttattgttattgctttatgtttttccagctacacaaactatcctagcgccgaaagcagcagcgagtgtcttacttgtctctgcattcgcttatctgattaaacggatcgtccgcagagaacgaccaaacgatcatcggttagtcgaagaaaaagaccacagcttccctagtgcccatgctgctacttctgccgcactttatggaactgcagcgatgaatatggcttttcttttgccacctgctgttctgcccatgagcattcttgcggtcctgctcagttttatgattgggttcagtcgcgtttatttagggatccattttttgacagatgttatcggtgggtggtttttaggattagcagttgctgcattgatcaccattttgttatgatttttggccttgcacagtatctgtttgatcattatagaatagcctcacctctcagtaataaaaaaaaggccgcgtatatgaagcgacccccaaaagttagaccaaaaaatctaacttttgggggtcgttatttgtatggcaaaatatccttttgaattaaaactaaaaatcgttaaagaatatcttagtggcgtgggcggatatcggtatcttgccaacaaatacggtatttcaagcaagtctcaagtaagtaattgggtgaatgtctatcgtgaatacggagaggaaggtctattgagaaagcatcaaaatcagaaatattctgttcaatttaagttaaatacgctagagttatatcaaacaagtgagatgtcctatcgagaagttgctagcactttagaaatgaacaaccctgcgcttattgccaattggatgcgtaatttcagagaagcaggtattgaggggctctcaaaagagaaagggcgaccacttactttgactagaaaaaaagaaaacaaaaaagaaaatacaacaactgaagaacgcgatcgtatcaaggcattagaaaagcaagtccgatcccttcaaattgagaatgcctttttaaaagagttgaggaagctgcgaaaacaggaagcccagcaaagacgcaagaatcaatcgcacgaatcatcgccagcctccgaggatcattcaaactagttgagcttcttgaaacattgaaatttcctaaagcaacctatatgtattggcagaaacggtttgacagaccaaacccagaccaagaaattgaagaaaaaatgcttgaaattcgcaaagatcataaagattacggctgtctgcgactaaaaaaagaattagagaatcaagggattcatgtcaataaaaagaagattcaacgtctgataaaaaaactaggtatcgaagtaaagtcttacactcgaaaatctcgacggtacaattcttatcgtgggaaggttggcactgtcgccaaaaatcgtattcatcgtcggttttatacaaatatctgtcaccaaaaaattacaactgataccacagagtttaagtattatgaagtagacaccacaggtgtcgttcgtcagaaaaagctgtatttagatcctttcatggatttctacaatagtgaaattctatcttatcggatttctgaaaaaccaaacgcactagccataatggaaggattagaagaagcaatccagatgacaaatgattgtccatttcgtagaaccttccattcagatcaaggatgggcctatcaaatgaatgcttataagaataaattgaagcagcataaaatcttccagagtatgtctcgtaaagggaattgtttagataactcacctatggaaaacttctttggtttattaaagcaagagatttttcacggagaagtctatcggagtttagatgaattgaaaacaaaaattgaccaatatatctattattacaaccataaacgcatcaaaaagaaattaaattggcgaagtccggttcagtttcgagaagctgtaaaaacagctgtctaacagttaatcttatcatacaaaaaaggagtggatttctccactccataaaagtctaactttttggggtcactacatatacgcggcctttttttatgtgattctttattcgcctttatgcaaatcgcgaatcatttcatcgatcttatttccatattgaacagattcatctagttcaaattgcaactccggaactttatataatgacagtgcctgtcccaattcacgacggactaaccctgttgctttctctaatccggcttgtgctttttgcttttcagatgcaagatcactcaaagtgctgtagaaaatcgttgcttgctgcaagtcccctgtcacgcgaacatctgtgatggtaacatcttgaacacgaggatcacggactttcttacgaagtatttgattcacttcttttaagatttcttgggcaactctacggtcacgataattagccattcaaaaaacctccctgataactagtgtcttaattcattggtacttcttccattacgtagccttcaatcacatcatctactttgacatcattgaatttctcgatcatggcaccacattcaaagcctagttttacttctttcacgtcatctttgaaacgtttcaaactagctaattttccttcatagatcacgatgccgtcacggattacccgcacaccgctgtcacggcgaatgctgccttccgttacataacaaccggcgatcgtaccaactttagaaactttgtaggtttcacgaacgatcatttgaccagtgattttttcctcaaattcaggatcaagcatccctttcatcgctgtttcgatttcttcgatagctttgtaaatgattcggtgtaaacgaatatcgacttcttcggcttcggcttgttgtttagcttgcggagttggccgcacattgaaaccaataatgatcgcgttacttgctgctgcaagtgtcacgtcactttcattgactgctccaactgctgaatggacaatattgacccgaacgccttctacatcgattttcttcaatgaagcacccaacgcttcagcagaaccttgaacatccgctttaatgattacattgacttcttttaattcgccttcttttaggctttcaaacagattgtcaagcgttacccggctgctggaagcgcgttgttccatcacggcgcgtttcgcgcgttcttcccctgctgcacgagctgtcttttcgtcttcaaatgtaacgaatcgatcacccgcttgcggcacatcattcaatccggtaatttcaactggtgtagctggtcccgctgttttgtcccgacggcctaaatcgttggtcatcacacgaactcgaccgaatgtgttcccgacgacgataggatcacctacatgtaacgttccttgctgtaccaataaggtagcaaccggaccttttcctttatccagacgagcttcgatcactgtaccgatcgcccgttgtgatggatctgctttcaaatcttctacttcagcaacaagtaaaatcatttccagcaattcttcaatattttgaccaaatttagcagagatttctacaaagatggtatcgccaccccaggcttctggaatcaattcatattcacttaattcttgcatgacatgttgcgggttcgcacctggtttatcgattttgttaaccgcaacgatgattggtacttttgctgctttagcatggttgattgcttcgacagtttgtggcattacaccgtcatctgctgctacaactaaaatcgtaatatcagtgatacttgctccccgtgcccgcatacttgtgaaggccgcgtgtccaggagtatccaagaaagtaattggtttgccatcgatatcgatttgataagcaccgatatgctgcgtgatcccaccagcttctccgcttgtcacacgagaatggcgcaatgtgtctaataacgttgttttcccgtggtcaacgtgtcccatgatggtaactaccggcggacgagaaacaagattttctttgttttgttcttctggttcaaagaatttatcgatatccgcgatgtcgatttgaactttttcttgtggttcaataccgtaatcagttgctaacaattcgatcgtatctttatccaatggttggttttgattgaccataactcccatcataaacaacttcttgatgatctcagcaggttcacgatagatttttttcgcgatatccgctacattcatgccttctgtatattccaatacttctggtaattcacggaatttacgtgctggaacaggtggttttttctcttgctgttgacgaccttttttcccttttttgttaaacttgttgcggttattgttattgaaattattgttgcgtccgttgtagtttgacttaccacggttttgatttccaccgcgattttggttatcaccagctggacggctttgtgttccttgactgctagccccttggtttggacgactttgttgtccttgtgctgggcgattttgactttgatttccttggttcggacgattttgttgtccctgtgctgggcgattttgttgcccttgaccgctaggacggttttgttgtccttgtgttctattttggttcgttggacgattctgttgtccttgattgttacgattttcttggttattcactcgattttgacttccttggttatttggtcgattacttccttgatttgttgatccgttgttttgacttgttgggcggttgggttgtccttgaccattaggacgagaattcgtcgtgttccgctgcccttgattattgtgtcggttctggaagttaggattatttctctgcgttttaaatttcttttgctcttgtttttccggctggttggctggtttctgatttgcgggagttggttttgctgatgatcgatcatttggattgccgcctaatgactgccgcaatttttgcgcctctccatctgagatcgcgcccatgtgatttttcacatcaaagcctaaagattgtgctttttcaacaacctctttgctcgatttgttccattcttttgcaagttcataaattcttttttttcccatgcaatcaccttcctaacctaatattaattcctgcaccttctttgcaaatcctgcatctagaatgcccaccaccattcgcggtttgccaatggctgaactgatttcatcggcagaaaatgtatctaggagcggaatttcataataagaacttttgtcctttattttcttttgtgtatttttaccagcgtcactagcgacaagtacgagagctgctcgttgttgacgaatctcttttaacgtcatctcttcgccagtgatcaatttcccagcacgcatggctagtcctaacatattcaatgctttttgtttattcatttgcaaataactctcttcgggctttttgatgcgtcacatagtctaagagttcttgataaaattcatctgacaatttcgtctctaatactctatccaagatccgcttatcccaagctaattgcgcttcctctggttcgatagcgatgtacgctcctcgacccggcatcttgccggatggatcgatcgcaacggttccttctttcgaacgggtgatgcgcagcatttcttttttgggaatcatttcccctgaaacaacagattttcgtaaaggaatttttcgttttttcatcgcgatctctccttgacttatttttcgtcaaaatccatgttttcgtaatcgtctgccgtcatatcagaagcaatgatcatttcgtcgtgagactcattatcctcgattgtgctttcttgactttcaacagcctcgccttcatcgatataggcgccttcttctaattttgcataaaattcttccatgtctgactccgatttgatatcgatcttaaagccagtcaatttcgcagccaaacgggcattttgtcctcgtttaccaatggcaagcgatagctgataatcaggtacgaccaccgtacaagctttcggattatccacatcaaaaataacatcagtcacttctgctggattcaatgcatttgcaataaataccgctggatcatcattccactcaacaatatccatgttctcaccttttaattcattgacaattgcttgaacccgttgtccctttggaccaacacaagttccgacaggatcgacattagcatcaaatgagcgcacagctactttagagcggtctcctgcttctctggcaatgctgacgatttcaactgtaccatcataaacttccggtacttcttgttcaaataaacggcgtaataaatcaggatgactacggcttacaaaaacttgaggccctttcgaagtattttcgacccgagaaacaaatactttgatccgatcgtgaggttgatagaattcatttggcatttgatcttgttttgataatactgcttcgatttttccaaggttcacatagatatagcgattgtcctgacgttcaacgatcccttgcaggatatctttttcataggcactgaattcattgtagatgattgtccgttctgcctcgcgcacccgttgcaaaatgacctgttttgctgtttgagcagctatccgaccaaaatctttcggggtcacttcgaaacggatcttatcgccaatctcgtaagcaggattgatcgtcatggcttctttcaaagacacttccaattgagagtccattacttcttcggtcacttctttgactgcataaacgtgaatattgccttttttctggtcaaattcaacttctacattttgcgcttgaccataatgacgtttgtacgctgacactaacgcggcttccaatgcgtcaatgacgatctcttttgaaatgcctttttctgcttccaatgcatcaagtgcatttaacatttctttactcatgattcttccattcctccgtgtttaaaattggattgctaaacgagctttggcaatatttttccgttcgatcgttagttctttttctcttgttttgattcgaatcttaatgactagttgttcttcatcaaaggactgcaaaaagccttcaaattgcttttcgccttccaccggctgatacaaggaaagatggatatattctccaactgcacggtgatagtcctcttcttttttgagggggcgttcagcaccaggcgaggatacctctaagaaataggcttgtgggatcggatctggatcacaggcatccaatttatcactcagttgttcactgacaaaggcacattcttcaatatcgattccgccctctttgtcaataaacacccttagaaaccagctttttccttccttaacaaattctacctcaactaattcaaaattttgcgcttccagaatgggggtcacaattgttgtgacagtttccaccactgtactcacacgacatcgcctcctttatttctcaacgaaacgaacttcattccattaaaaagagtgagcgaaaaaaccgctcactcactctaagtatcattactatgtaaatataacatagtttactaacaaattcaagtatcctagcattttgtggctttttctgaaaattttacatcctatttcttaagatttcttccttcagaatacttccttgttccctctatctcaaaataggcagctgtctttcttgattcaagcaatgaaggcgacaagcttcgtgatgacttgtggaagcaaagctttcggatcaaagtccatcggcgcttgatcaggaaaaaagtgccacatgcggtagccataaacgcccagaacagcaatcatcagtccaagccaaaagtagcgattttgattgatacgctgaaccatgggctttttccagaaaatgacaagtaacactagcaaaggaatgagccaaaaaagtggatgaaaataaaaagcgccttgtatgtcaccttcaaaaagatgcaaataggcgcgagtcattccacatccagggcaaggaacccccgtcagcagtttaaacggacacattaataatcggtccaatcatcagtgtcttgagtaactgattggcttgcagaatctgcagactcccacacttgattcatatccgattgtaaaatggccatattgataatgtccaaaccaaaaatcgctaagacaacaaacaacactttattatcattgatacgtggaaatttcgttttttcctgtgcagtgataaaaatgtccgcgattcgataccaccaataaatttggtacaacccgcaagtaatgatcgtcaacaacacagacatgcctggggtaaggcgataatcttcactatattctgtcaaatcttgcgtggtttggtatagccagaaaagtgaatagatgccgcaagtaataatagttagtaaaatcaccattaaaatggactttttcttggattgataattttgatacatcggttactccttctaaaagattgaatctttttacttttcttccaattatacaccaatccaaaaaagtggaaagtccttttaaaggaaatttatttcaataataatgaaaaaaaaggatgtaatctaagctttttaataaacgaaacctctgaaggacattgggatgctgttaatctccaactagtcaccagtaataacgccagctggacaaacactttttttccactgtcattcggatagtctcattttttgcttctattacaaaccttttattacaatccttttaattgatttatgcgcgactataattttttacttctgctgccattgcatcaacaaagatatttagttcttcaacgttcgtttctttgctgccgtaacgacgaatattgacagttgcatctttgacttcttggtctccgacaactaactgataaggaattttttgcatttgtgatgcgcgaattttgtagcccattttttcattgcgatcgtccacttccacacgtaaaccttgtgattgaagacgttctttgatctcataagcataatcgctgtgtgcatcgactgaaacaggaatgatcgttgcttggatcggtgccaaccaagttggaaatgcgcctttgtaaacttctgttaagtaggcaacgaaacgttccattgttgaaacgatcccgcgatggatcacgactggacgatgtgtattttcaccatcttcaccaacataagttaagtcgaaacgttctggtaataagaaatctaattggatcgtggaaagcgtttcttccatgcccaaagcagtttttacttgaacgtctaattttggaccatagaacgctgcttccccttctgcttcgaaataatccaaattcaattcatccatcgctgctttcagcatggtttgggcattttcccacatcgcatcatcatcaaagtatttatctttgttttctggatcacgatagcttaaacggaagcggtaatctgttacattgaaatctttatagacttcaaccatcaaatccaaagtccgtttgaattcatctttgatttgatcaggacgaacaaatgtatgtccatcatttagagtcatttcccgaacccgttgcaacccagaaagagcgccagatttttcgtaacggtgcatcatccctaattcagcgattcgaatcggcaattcacgataagagtgaatatcgtttttgtagaccatcatatgatgagggcaattcattggacgaagaacgagcatttccccatctcccatgtccattggcggaaacatatcttcatgataatgatcccagtgtcctgaagtcttataaaggtcaacattggccatgattggtgtataaacgtgttggtaacccaagcttacttctttgtccacgatgtagcgctcaatggtacgacgaatggttgcaccttttggcaaccaaaatggtagaccagcaccaacttctggagagagcatgaataagtctaactctttccctagcttgcggtgatcccgctctttggcttcttctcgtaaacgaatgaattctttcaactcttttttgtcaaagaacgctgttccatagacccgttgcatcatttggttatttgaatttccacgccagtaagctcctgccacagataaaagtttgaacacttgaatccgtcctgttgatggcacgtgaggcccgcgacatagatcaacaaactctccttgttgataggcagtaatcgtttcatcttctggtagttcactgatcaattctactttatatggatcttcagcaaatagttctaaagcttcttttttcgataatacacgacgttcgatcggtagattttctttaacgattttcatcatttctgcttcaattgctggtaaatcttcggcagttacagggctttctccattatctgtatcataatagaatcctgtatcgatagctggtcccacgccaaaatgaatgtttggataaaggcgacgcatcgcctgagccattaagtgagctgctgaatggcgaaccaagcctaaagcatcctcatgatccggtgtgacgatttcgatttgtgcatcctcttcaatccctcgatcaagatcaatcaactgaccattgacctttcctgctaaggcttttttcgctaaacttttagagattccttcagcaatttcttttgttgtgatgccaactgcaaattcttttttcgccccatctgggaatgtaattgttagtgtcatttgttttccccctactgatttatttgatcaatgaatgattcgaaccaaaaaaagtcctagtatcagataacgatactaggacgaagatttcgtggttccacctaatttcaaatacaacaacgctgtatttctttgacgggataacggtacgaccgcctttgtttcaacaaaggtttgaaaaagtggtcatccattggttttcttccaggaaattttcagccgtgatttccctctcttatcgaagactctcaaattcaggtgtctttttcatcaatcaattatggcttcatttaaccactatctgcttaaaaaatcaagtaaattatttccaatcaccattaactgcatactgtccttttttcatttcgttgataatgacatgaatatgttctttaggtgccccagtatttttgtggactgcttcagtaatttctttcatcatattggtcaattgttcttgcgatcggccttctactaattctacatgaataaatggcatagtcatcactcctctgttcattagtatacgcttcttaattatgctctgcaataacctgctctattatcgaatgactgtcccttatcaagaataagcgtttctgacaatctaaagattcttccatttcatttggctggatcttcacgccattttctcgaatgccatttttgaacatacttcatcaccttactggcttcctcttcatggtacaaaaattgatgttgtctgcttacataacgagcaatctcatcaaatagttgaacgattttccataaggattcgccgcaagtttcaacagatgaaaaacaaagtgccgtcaaccgctcatactcttcttctgataaataattttgaagatatttatggttctttccggtactgagacgatagtctgcttgatgcgctagataccagtcatattgccgaagcaactcttgccagcaaatttggtacaaatggtcggcggcatagaaaagctgatttctgacaagccctttgacgacataagtcgctacccaccaaaattcgttacaactgtcatgaaacgatttttctgtcggtggtttaatccaaaagatagaggcatcaggaactgtcattccctgcagaaattcttttggatcatagagacgctcaagaaagggttcagcttgcaacaaatggatcaattcaaccgggcaaagcatcaagtctatgcgattgccatcttcaaaaatgcatcaagaatgtaaaacgtcctcccaaagagggttgcgaaagcacagaactttctggagtctgcatgatcatgatctgtccgaattcttccagccagctaggttctgctattagttcttgcatattgtcaacaatataaacgatatcataatcttgaaaccgatcgcttattgcattaggttctcgccgggacccagagattgcgattgcttggacacctattttttgaccaactcgtaaaatcactgctagcatttcagcttcattccgcacagctatcctccctttctttgatccaattgatctcaaaagcatacttaaattttaccatagaacgatttttcagacgacattcgcaaagattatatgctataattttatgtcgcaatttttttaaggaggattccttgtgaacgaacgtcaaaaagaacaactacatgtcgatgatacgatcgcattgattcgaagagaacaaatggtcttagcgcagcaaaaagcggacttggctacaaaaatggaggatcagttaaaagagatttccgaaaagaagattcgtggtggtgacagcgaagctttttacgaatctgttgttgaatatcagcaacacgagcaagaattgctgttaaaatatcgaacagcggaatctcaagagaaaagggtcaaaacattggaaacaatggctagcaatccttattttgcccgaattgattttcaagaagaacaagaaaaagaaacactttatctagggatcgcctctttaagggatcagcaagaagaaacaattgtcatcgattggcgggcacctatcgcaaatttatattacgaaggagaattaggcgaaacgttttatgaaacagaaaccgatcgctttacagttgagttgttgctgaagcgtcaattcaaaattcaagaaggccagattttgtctatggtggacacttcagaaatcatcaatgatgagtttttgctggagattttagacgaagcctcttcttctcaaatgaaaaatattgtctcaacgatccaaaaagcacaaaatcagatcattcgtgatactactagcaagttcatgctgattgaaggaattgccggcagtggtaaaacatcggcactgttgcaacgggtggcgttcttgctttaccgcaaccgcaaatggctggatgaagaacaagtcttgcttttctctcccaatcatttattttctgattatatttcaatggtcttgccttctcttggggaaagtgaagtgccaacacgtacgttccaccatttcatccaaagagctctgcccaatttccaaatcacaaaagaaacacagctagaagaaactttcttatcaggagcagacgatcggattgaaaagatcaaaagcagtctgaaacttgtcaaattgattcaacgatacgtacagaagatttctgcgatcggtccgttatttcgtgatttaaaaattcaaggacagacatacattacgaaagaacaaatccgtcgttggtatcaagaaacaaatcaagagcttcctttgtatcaacggagtcaattattacaaacaaaattactgaaaaaaatcggtggtcttgaaaaagatgaggccaaaaaagattgggtcaaagaagcaaccgaagagcagttgcagcaacattttgccaaagatccttatcaggagtacaccgaagaaaatgaacaccgattgcgtaagcaaatccggcagcaaatcgttaagaaaaaattccgctcactaactcgtggtgtcaaacaataccagtttatcaaccaaaccaagcagtatttacatttcttacaggcagttcctaagacgttgttagacgatcaagcgatccgtgatgaagattggcaacaacatctccgacttctgcgagaaggtctgcggcaacgccaattgacccaagaagatgccgtgctattctttttgttgatcaaacaactttacccaatctatgtggatgaaaaagcacggtttattttcattgatgagatgcaggattttccgcctgctcaagtggctctcttacgtcaattatatcctaaagccggaattactttatgtggtgatttaaatcaaaaggtctacggtaatgaaacgatcgttggttcgttggaagagttgtttcctgctgacagcgtgactcggtatcaattaaaaaccagctatcgttcaacgaaagaaatcacggattttgccaaccaattcttaactggttccgatcaagttgaattgacagcacgcgaaggggctctccctcaagtcattcaaaccgagaacgaaacagttggtctggactacttgcagcaagcattaaccaaatcacagtcacactggcgcacagctatcatctgtaagacagctaccgactgccgagcgctttatgcccagctctctgaagagatgcaggatcaagttcaattaattacttcagaggaagattttatgaaacgtaaaatcatgatttttccagcctttttagctaaagggttggaatttgatcaagtattcttatggacgtatgggacttcttttgtgacggagcaagatcaattgatcttctataccatggcgacccgtgccatgcaccaattgattgttttgcaaaataacaccaatcaattgctagagaaagctgatcccgcaacctacgcattacaattgctttaaggaaagcgattgatacatcaaaaaaacgagagcaagcggacaatcccttgctctcgtttttgcctagcgataaatgatcaatcaaacaatattcttctcgacaaaagccttgtttgatcggtatttgttttgtcatttttttacagggttcgatcaccccttcaattcaccgataaagagtctcgtttctggatatttcatcgcgacaatcgtcaaaatcatctgaagttctgaaacattttcttcattgtcaggatcaaagattttactatgttttccaatactgccattgtcgatcaatcgatagatccggttccattccataaattgttcgacatctgtaaagtgactgaggggaaaaccggaaccatctagaatttctgttaaacgaaaagcaatataagaactgtcgatcacatattccctttcaggatcaatttgattacttttctgaaaatcaatgattgctttttctggacgatgatgcagcagccactctaacaacaagaaaaagccttccatccgataattgtccaaaaataagcgttgggacgcttccgatactcgaaaaaccagcgggatcaaaaaattccgtttataaatcagtaaaggcgcacgatctaccgtcacattcaagtaacgattcaaataggtggctccacgaaagccgcccaaacggtatccctctacaccgtattttttgtatttgcggcacagtgcagaacaatcagaaactgagacagatacttctgctaatttatcgtatccgcttaaaatccgatcaaaaggctctaaaacgattttttcttccaactctgccgctcccttcttgctcatactgctaattacttaaataataacataaaaaaagcgattaaaccaaaagaaatacccctttgttttttgaaaacgataaaaatgaaagtaaaaaaacacccccgaaagcacagataaactttcaaggatgtcttacttttattcttcttcgctgtctgctacattatgataaacgttttggacatcttctaagtcttctagtgcatcgatcattttttcaaatttttcaagatcttctccagtcaaagtgacttcattttgaggaatcatctgcatctcagcaattgaaaactcagtaattcctttttcttttaaagcttcttgaatcacatgaaaatcactaggttctccatggacgatgatttgaccatcttcttcaagaacatcgcgcacgtcgatgtctttttccatcaagtattctaagatgtcatctgcatccgtaccagaaaaaccaaataatgccgtattatcaaacatgtaagcaaccgcgccagaaacacccatgtttccgccatttttaccaaaagctgctcgtacgtctgctgctgtacggttaacattattcgtcaatgtatcgacgataaccattgaaccatttggtccgaacccttcataacgcaattcggagtattgttcatcccctgaaccttttgctttctcaattgctcggtcaatgatgtgttttggtacattgtatgtttttgcacgttcaataacaaagcgcaatttttggttcgcatgaggatcaggatcacctgattttgctgccgcgtagatttcgattccaaattttgcataaactcggctattgtttgcatccttagcagttttctttgctacgatatttgcccatttacgacccataatttcacttcgctttctttataatcaaaattccttaatcattatacttgtgatttcctgttctgtgaagtaatttcagttcaattctttagaaaaataggggaacgaccaaaattttgttctacaatctgtggtgatgccaactgatagatttgatctacccgtaaagaatacccaaaacgctcgctttcctttttgccaaatttagaaatgagcggcaggtctgtcttctttttaacttgctttaaataagtttgacctgctgttgtaaaccccaaaatacgaatcccggtattcttttgcgcttgttggacttcttcactggttgcttgaaacaatagataacacatcaaccgctgaagtctagttctagtataccgttttgttttcagaagtgccataaattccgcaaaagaagtggcgtgtaaacaatctttgatccgatattctaatccttcggtcacttgataccgggttcgcaattgttcaagaggggttgcgataagttggtactgcaacaatggccaaaaaaactcccaatcaatcgtttggtctaataaatcatttcttacactttcaggaacgtaccctttaatctcttgacctgccttcacagctttgcgaatagccgtcgcactggcaatcatcccaccagacaattcttgtgagtgataggccgcttgtttccttgaaatcggcaacagtttcattggtgatggatactgacacgtttcacgagcatagcgcatgcccaatatgtgattaggcaaatgagcctctgccaaaaagtctggatagactgctgcaaaagccgcatgcattttttgtgtataggtttggttctcagaagcattctcttggaaaaactggtcgatgacttcttgattgtttcgctcaaaatgcgcaaatgcttcataatcaaatggttcgggagcgtccgttccaaaacataaaaaggagcaatccaatgattgcagaattctaattgctccttttgcaaagaaatcagctgattgaactgaccaagccggcggtaattctacaattagatccacgccattttcgagtgcagctcgagcacgctgccatttgtcaacgattgccggttctcctcgctgcaaaaagttgccactcatcaccgccacaacaacatccgctccagatgcttttctagcttgctggacatgaaattcatggccattatgaaaaggattatactctacaacaataccgcatgcttgcatttctccactcctttctcccatcagcaaaaaaatttaagttctttttaatctaaaaaaaaccgcaaacaatcaaagcttgcggcagacaaagaaccaacgacggctcttttcatttggcggactatcaataaagtctgcatacatttcgatttcagagaagccagcattttctaacatccgctgataactttcaagcgaataggtgcgttctcggtgtagttcatccattcgttggaaagttccatcctcattttgcacaaaaaaagtcaaaaaatgttcaatgctgtgaggaacttctccttggtaactttcccagagaaaggcaaactcatctgtttgatagtggtagctgtaatcagggaatacttcatcgatctggtacgttgagtgtacatcgaacataaataccccgtcgtcacgcaagctgttataaaccccatcgaaaacttgttggacactttgttcatcttccatataacagattgagtcagagtaacaagtgatcgcttcgtaggttcccacatctgtcagatccagcatgtccccttctaccaattggatgggcgtatcctcttgttccgcccgctgactggcgatcatcaacatttcttctgaaaggtctaagccggttacatcaaaacccgcttttgcgaattctactgctaatgcacctgttccgcaggctagttccataatttgttttttttcacctaaatgacagcaagaaaaatccagccacttttgatagagactggaatccattacttcgtcatagacaaaagcaaatgtttcgtaggccattattaagccacgacccattcattcagatcaacaagcggtgcatctgaccataatttttctaaattataaaacgcacgttctgaagcgttgaaaacgtgaacgatgacatcaccaagatcaatcaagacccatttaccaccatcttttccttcaacacggcgaacctccacttggttttcttcttctttgtcaagaacttcatcaatgatggcattgatttgtctgtcactgttccctgaacaaatcacaaagtaatcggctaataatgaaatttcacgaacgtctaatgccataatatcttcggcatgttttgaatctgctgctttaacagcaatttctaaaattctctggctatctatggtaattccctcctaatggtttgcgacccaatgattgtatgtttcaatcgtcttgggataaattggtgcttccttttcaatcaaataaagcaatgtatgtttcgtttcgtaagctactgcagcgtcaagatcaatcatagctaattcacgggcttctttcacaccaggaaatgaccgaccaggttcgatataatcggcaacgtaaatgatcttatccaacaaactcatttctgcagcaccagtcgtatggatacgaatggcttgtaggatctcttcgtcatcgatgcctaactctcgctgaacaaaatcggctcccacaataccatgccaaatagcattgctccaattgagcaattccagatcaaaaccatctcgccgaatgacaagctggaattcttcatctggacgctctttggcataatcatgagtcagcgcagcgatactggctttttccggtgaagcaccgaatttttcagccaatgcgacagccgttttttccacacctagtacatgctgaaatcgtttttggctcatatgcatttgtacttcctgcatcaataattcgcgttcagcaggcgtatactgttggctattcatccagatacagccccttttcttgaatatagtttaacacattttccggcaataagtagcgaatcgagcatccttgttgcactttcttacgaattattgtggagctgatatccatcaaaggcacatcgatccaaatgatcggatagggtgtttcaacgggataactaggacgacgaaccccgacgaaggtgaccaactccatcaattcatcaatccgatgccacttcggcaagtattgtaccatgtcgccgccaataataaagtaataacttgtatcagggttcttttcagtcagttccttcattgtatcaaaagtatagcttttccctttacgtttcaattcaatgtcttcaatcgcaaatcggggattatccgcaatcgctaactgtaacattgccagtcggtgagcagccgggatcgtctttttttcatcgacatgcggcggaagatactcaggcataaaatagactttatccaagcccaaagcttgcccaacttcttcacccatgaccaagtgggtatagtgaacggggttgaaattcccccccagtatgcccacttgttttttaggcgcttgataagccgcttctgttgtatataaggtctgaactttgccaaacgaatttccttgcatgtcaaatcactcctataatgaacgtacgtttacagagatttttttatatttttcttttgtagatggtttgaataacacaatcacgcgtccaatgatttgaacaacctcgcattgaatcgcttcactgattgctgtagcagcgtcctccgccacttcgtcggtattttgcaataaagataccttgatcaattctcttttttctagcgcttcttcgatttgattgatcattgcctcattcaacccgcctttgccaatctgaaaaatcggtgttaaatgatgcgcttcactgcgtaaaaaccgcttttgttttcctcgtaattccatgttctgccttcttcctttaaattaatgctttccgtttgatcacatcaacgcctttgggtgcccaaccagcaacaactcctggttttgtgactgtgatccatcctaaacctgcaaaaacaatatctgttttttctttgatcgaaaattcaaagcgaactaactccggaaaatcagctaactcatcaggacgaggcggttgtaaaagaccaccaacatgtttttgataaaaagcatcagctttttctaacttcgtgcgatgcagcaccacatcatttgctacataagcaatgaatgagctgcgctctccttgaataaagtcaaaacgtgccactcctccgaaaaagagtgtttggccagcattcaattggtagcttttcggtttgatttccttattcggcgccacgatttttaaatctttctttccaaggtaatgagccatctgatgtcggtggatgatccctggagtgtcgatcaaaaagtgaccgtcgtcgagaggaatttcgattttatcaagggttgtccctggaaaacgagaagtagtaatcaattcttggactccagccgtctgtttgatgatttgattgatcaatgtcgacttaccaacattcgtaacacctaccacatagacatctcgaccttctcgataatgatcgatcgcctgtaacaattcagtcatttcggcggctttttttgcacttgtcaataaaacatcgattggacgcagccctgcttcatgggcacgctctctcatccattgggtcatttttgatttcttcaatgactttggcaagatatccactttattgcccactagcaacacaggattgtctcccacaaaacgatgaagtcctggaatcaacgaaccgttaaaatcaaagatatccactacatttacgattaatgcatctttttgaccgagttcgttcagtaaacgcagaaaatcatcgtctgtcagcgagacatcttggatttcattgtaatgtcgcaagcggaaacagcgttggcaatagacttctccggtttctaaccctttctctaatgcagagagcggtgtataaccaagctctgttggattttctgtctggatcagcgcgccacagccaatacaatgaatcatttcttcattcattatcaaattccacctcgccatttcatttctggattgtgtttcaataaatacttcataattcttcgctccagcaaacggttgaattgtgttttccatgaatccgtattaatgatcggcttcactaagatactacggacccctgctcgattagcaccttgaatgtcggtcatgatttgatcaccgatcatcacaacatcttctttttgcaagccgagttggcggtatccttgcttgatgccacgagaaaaaggtttcaatgctcgatggacgtattgcaaaccaaagggcgccactgcccgtgcgacccgttcactattattgtttgaaacgacaatcaccgggattcccgcattcttcatttctaacaaccaattttttagctcttcactaccgtcaggatcattccaagcaatcagggtattatcaaggtcagttagaacagctttgatgccttgcttcttaagttgatggggagtgatctgatagatggcatcgaccatccaagtcggtttaaattttgaaaacatagattctccttgattcttttattcatgtgacaaaaatagtcaatttgttgacacgtctagataaaaacagcttgtcagctgacaagtcgtcaatcagtccccacagggtcactgatgattatttaaaagcatcctacttataatgctactttcaacctgtaattatacaatagaatcgtgtgaaatactagactgagctacaactctcagcaacagattttcatctagttgaaaaaagcaacggatcatccactgctactttctttaaaaaataaaaaagccgaacgatcagaggagtgagcaatcaatgcagattacttctgcagcttccttcctcaagaatcgttcagacaattcattgtttttcatcttgaccgatatgaacgcacatcacactaaccaacttcatggtctaaaaaagatcataagacttttgccagaaaatcgattgtccgcggattttgcggtgcatcaaatatttgagcaggagtcccctcttccataatgaccccttggtccatgaaaagaacgcggtcgccaacctctttggcaaatcccatttcatgggtaacgatcaccatcgtcatcccttcttgagccaaacgctgcatgacactcaatacctcaccgaccatttccgggtctaacgccgatgttggttcgtcaaacaacatcacttctggctgcatcgccaatgcgcgagcaatagcgatccgttgcatttgtcctccggataagctttggggataagcttttgctttatccggcaaccctacgtcagtcaacagtttctctccgattttccgagcgtcttctttagacattttttttactttgattggcgacaatgtaatattatccattactgtcagattggggaagaggttaaagttttgaaaaaccatgcctaatttttcccgcatttgataaatatcattttttttgtcagtaatgtccgtccctttaaagtaaatattgccgcttgttggttcttctaacaaattcaagcagcgtaaaaaagtactctttcccgatccggaaggtccaatcacaacaacgacctcaccttttttgatttcagtattgatacctttaagcacctgatttgttccaaatgttttgtgtaaattctttactttgatcattgtatccatcttttttcctcctatcgccggtaacctttgccgagttttttctcccatagattcaacaagcgggaggtggtaaacgttaaaataaagtaaattacagcggcaacatataaaggagttaatggctgatacgaacttgtcacaacaatttgtgcgctattcatcaattcgtagataccgatagtggataacaaagaggagtctttgatcaaaacaatgaactcgttacctagaggaggcaagatattacgcaaagcttgaggtaaaataacataccgcatcgcttgtgcaggacgcaatcctagcgaaccagctgcttctgattgaccaaaatcgactgcattgataccaccacgaacgatttcagcaacgtaagcccctgagttcaatgaaagggcgataatccctgggaatagtcgtccaaagtcaagattcaacacaccaaacgaaatcgtcggcagtgagaacagcccctgcaataacccaaatgcaatcaatatctgaaccagcatcggtgttccccgtaacacttcgatatacgtattagcgatccagcgtaatggttttacttttgataacttcatcaatgcaaaggtgattccgaggatggtgcctaggatcactgtaataatggagatgacaatcgtaatcaatacccctgagataaagtaaggataataagtcgacaagaaggaaaaatccataaatttactactccgatctattcagccgcattttcgttggctaagtctgtattcttttgaacgtattcattaattgtccctttatcattcaattctttcaaaatacggttcaattcatcttttaattctgtgctgccttttggtagagcgatagcataagaatcatctggtgaagcttccaaagcaatgtcagccactgccaaatcatcattttgagcaacatatgagtctgcaacggcactttcaagtactagcccatcgatcgatccttgtttcaattcattgatcaagttaggcactttcgcaatcgaaaccaattgtgagtcagctaattggttttgaaccacagcctcttggatcgatcctttttgggcgcctaccttctttcctgaaaagtcatcgattgcagacaatgcatccgtattgtcctttttgatcacgattttttgttcaggtgtaaagtagttgtcagtaaaatcaaatgtttgttttctttcatcagttgctgagatcccagaaaccgcaatatccgcttttccttggctcaatgcagttagaacagcattgaactctaagtccattacattgactttgacgcctaattctttggcgatttcatttaccagatcaatgtccgcgccgacgatttggtctttgccatcaatcaaagcatggaactcaaaaggtgcaaaatcagctgatgtcgctacatttaatacaccagcagacttgatagcttctagctgattttgatctcctttttttgacgaatcagtgcttgatgatccaccattcccacatgcagctaaagttaataaagcagcaactgttataaatccactcatcaatttcttcatttgttttctccccttataaaataaataattatgcatatattcccatctttattcagaatatatacataataccacaatgttattgaatttcaaacaactatctgctgatgtttattatattagagaaatttcacaaggacaaataaaaaagcttgaaatcaatgacggatcaaaaatcgacattgatatcaaacttatgattaaaatttgcgaaaacgctgatagcgctcagcaaggagttggtctatattcttttgtgctagagcagcgatctttttggtgattgccgatcgcatttccgcgatcactgtctctttcgacaacagttcaccgtcgatggtctcgggaatcactttttcgatcactccaagcttgtgcaactcttgcgctgttattttcatgagtccggcagcttctttcgcacggcttccatctttccagaggatcgatgcaaagccttccggggataaaatcgcatagatagaatgttccatcatccatacttcatcccctaaagccaatgccaaagctccaccactgccgccttcgccaataatgattgccaagattggtacttttaaatctgacatttctaagagattgcgcgcaatcgcttctccttcgccacgctcttcagcgccgacgccgcaataggcacctgctgtattgatcaatgtgataacaggccgttgaaatttctccgcttgtttcattagccgcaacgcttttcggtaaccttctggatgaggagcaccaaaatttcgtcgaaggttctctggcaggttccgccctttttggataccgatcactgtcacaggtttcccatctaaggcagcgaccccgcccacaacagcttcatcatcggcatagagacgatccccatggaattcctgaaaatcgctaaaaacatgttcaaagtaatcaagtgccgtcaaacgatctttgctgcgggctaactcaacgatctcatgtgccgcttcaatcatttgtcatccacccctttgtcgtatgcaatttaagcaattgggaaattcgttcccttaattgtgtccgtggaacgatttgatcgacaaaaccatgttccaacaagaactctgctttttggaagtcttctggcagttcttgtcgaatcgtttgttcgatcactcgtctccccgcaaacccaatcaatgcctgcggttcagcgagaatcacatctccttccattgcaaaacttgctgttacgcctccggtagttggatctgtcaagactgtcaaataaaataaaccggcttcactatgacgcttcactgctgcagagattttagccatctgcatcaatgaaaaaatcccttcttgcatccgtgcaccaccagaagcagtgaataatacaacgggtaagttcttcgcaagcgctcgctcaaacaatcgagtgattttttcacctacgacagttcccatacttcccataataaagttggaatccatgattcctattgccacaggttgctgattgattgtcgcttctccagttaacacggcttcatggagaccagttttttcctgtacggaagctattttttcgagataatcaggaaagttgagaggatcttctattttcacatctgtatcccattcttccaagcttttttcgtcgatcgttaatgcgattctttcccaggcactgatacggaaattatagccgcaatgaggacagactttttctgcgcccatttcttttgtatataaggtccgtttacatctgggacatttcgcccaaagattgtcgggcactgttggttcattggcaggtgcctggccgcgattaggattgatgcgaatgtaattcttctttttaaataaagccattctcttccctcctattgttcaggcgtccagtttggcaagaattcctcttgtaaaaaggctgtgttgtagtctccggcaatcacttttggatgaccgatcagatccatttggaattctgcattcgtcactacaccctcagtcactaattcagccaaagctcgctgcattttcatcaatgcttcaaatcgattttctccatgaacgatgacctttgcaatcatcgaatcatagtaaggaggaatcgtatatccagagtacatggcactatccacacgaacgcccagacctcctccaggtaaaaacaaattgtgaatttttccaggggaaggagcaaaattaaaggctggattttccgcattgatacgacactcgatggcagcaccttgcattttgatatcttcttgtttgatatccagcggttcgccgctagcaatctcaatttgtttttttacgagatcgatattggtcaccatttctgtgatcggatgttcgacctggatgcgagtattcatttccatgaaatagaattcgccagcttcatccatcagaaattcgattgtaccagcattgcgatagccaacagcctgagcggcgcgaactgctgcagctcctagttcttgacgtttactagctgatattacgaccgatggcgattcttccaaaactttttgattgttccgttgtaaagaacaatcccgctcgcccaagtgaatgatattcccaaaagaatctcctaaaacttggacttcgatatgtcttgcgggatacacgattttctcaatatacatttcatcattaccaaaagcggcttttgcttcttgctgagcggaagaaaaatgctgcggcaattcttcttttgtcaatactttacgtatgcctttaccaccaccgcctgctgctgctttaagcatcactggatagccaatttcttcagcgatcgtcaatgcttctttcacatcagaaatcgctccttgactgccggggatcactggcacttgtgcttcgatcatcaaccgtcgggcattgattttgttccccattgcatcgattgtttcactcttaggaccaataaagacaatattgcattcttcacacatagatgcaaaacggctattttctgataagaaaccaaatccgggatggatggcttcagctttggtaacgatcgcggcgcttaatatttgttgcacattcaaataagagtctgctgctttcgccgggccaatacaaatggcttcatcggcaagttctgcatgtaacgcttctttatctgcttctgaataaactgcgaccgtttggatcccaagttcgcggcaagcacgtataatgcgaacagcgatctcaccacggttagctatcaatactttagaaaacatttttcacctatccaatcatgaaggtaagttctgcttctgcaacttttttgccatcaacataggcaatccctttgccgattcctgctgcagattttaccttgagtatttctacttctaagatcaatgtatctcctggtgttacttttttgcggaattttgctttatcaagtccgccgaaataagcggttttacctcgaaaatccggtaaagacaagagtgcaactgcccccgcttgggccattgcttcaacgatcaatacaccaggcatgactggttcatgaggaaaatggccttgaaaaaaaggttcgttgatggtcacgttcttctttgctaccacccgttttccttcttctagttcttcaatgcgatccactaagagcataggatagcgatggggaatgatttctttgatttcttgaattgacataactgacatagcttacccttctttcacacggaataatggttgatcgtattcaacgatctgctcattttcaactaagatttcaactaattcgccatcaacatcgctaacaatttcattcattactttcattgcttcaacgatacaaaggacatccccttttttgacagaatcgccgatttgtttgaattggctttgttcaggactaggttttaagtaaaccacacccactaaaggtgaaacgatctccgttcccgctataattggctctgaactaacctcgagggttccagcagctgttggttgtacgcttggtactggtgcagctgcagggatgctttcaactttgacatctgaactctcggatgaaccttgacggctactgaacgaatttttattaaaataaagttcgatgttttcttttttgagctgcaattcagtcaaagaggactgatcaaattgggaaagcagatccttgatttcatttgtttccaattaagcttcctcccaacgtttcaataagatgactgcattgtgtccaccaaaacctagtgagttactcattgcatacgtaatttctgctggctggctttggtttttcacaatatttaagtcgatttcaggatcttgttcacgaacattgatggtcggtggaataaattgatgctgcaaggctaaaagcgaggcaattgcttcgattcctcctgctgcccccaatagatgtcctgtcatagattttgtactgctgacgtaaggtttgcgatagtcgtcccctaaaccatattggatcgatgtagcttcagctacatcattagctggtgtgcttgttccgtgagcattgatatagcctacttcggctggagtgatcgctgcttcagacatcgcgagtttcattgcttttccagcacctgaaccgtcaggattcggtgcagtcatatggtaggcatcacaattggcaccatagccaacaacttccccgagaatcttcgctccgcgcttttgggcatgttcaaatgattctagaatcaaaaccccagcaccttctcccataacaaacccgctgcggtttttgtcaaatggtgtggatgctttgtctggatcagattccgttgttaatgccgttaaagaagcaaaaccagcgataccaatctcacaaatcgttgattcagatccgccagcaatcatcacgtctgcataaccatgtttgatattgcggaaagcctcaccaatcgaatgagtaccggatgcacaagcagagaccgtagttgtacaaataccttttgcccccacacgcaatgcaatgtttcctgccaccatgttgacgatcgacatgggcacaaacattggagacacacgatttgcacctttttcatgcattcgaatcacttggtcttgaatagttggcaaacctccaatacctgatccgaccatgacaccgaatcgatcggcatctaacgcttcagaattcaaacccgccattttcattgcttcaagggcagcatagatcccataaatcgaaaaaagatccatccgtttcgtatcttttttgacaaagtatttttctagtggaaactctttgacttcagctgctactgaaatccctgttccactggcgtcaaatttggtaatggggccaatcccattggttccattttgcaaactagctaaaaatgtttctggatcattccctattggggaagtcacaccgtatcctgtaataactactcgattcataagtatctcctttctatccttgcatggccattccgccatctacgctgactacttgacctgtgatataagcgctttgggccaaaaaaaccgcagcttttgcgacatcttctacagcaccaaatcgctgcaacggaatattattgatcgattgttcttttaccttatcagaaagaactgcggtcatctccgtttcaataaatcctggtgcgatcgcattacaggtaatgcctctagccgctccttcgcgggcaactgatttggtaaaaccaatcacgccagctttacttgctgcataatttgcttgaccaatgttgccagtcaatcctacgacactagtcaaattaatgatacgtccttcgcgtagtttcatcatctttttgagagctacttgcgtcatgttgaaggttccagtcaaattgatcttcaatacactttcaaattcttctggtttcatgcgcaacaataacttgtcattggtgattcctgcgttgttgactaaaatgtggatcggtcctaattcagcttccgcttgtgcaagcatcgaaacagcttgatcgtattcggatatatcaccgttgactgcgatgcatttcacaccaaaacgggtaatcgtctctataagagtttgaggtatctctttccgcccattcaatacgatattggctccttctttggcaaatgcttctgcaatgccaaagccaatccctcttgaactaccagtaataaagacatttttatttgtcagttccataaattcctcctaatcaaaccttgaaagtgtgtcaaaaagtgtttgagcatcttccactctcgaagcagcaatggttttgtcgatttttttcaaaaaaccggtcaatacttttccgggaccgatctcgatcatctgctcaattcccatttgtttcaactgctcgatgctttcataaaaacgcacaggtgatttgacttgcttctctaataattctttgacttgttcttgtttcatcggtttcgcagtcgtgttgctgatcaccggcacctgtaaatctttgatttcaattttcgccagctcttgagcaagttgtttagaagcgggttctaaaagttttgtatggaaagggccgctgacatttaatggaatcattcgtttggctcccgccgcttgcaataactgaacggcttggtcaaccgcagctacttccccaccgatgacaatttgctgcggcgtattgtaattagctggcgaaacgatccctacttggctagcttctttacaaatcgcctcaatggtttcagccggagtattcatcacagcgaccattttacccacaccctgtggtgcggcatttgccataaacttgccgcgtttttgcacgagggctacagcagtttgaaagtctaatgcgccgcttgctactaatgcggaatattcacctaagctcaaaccagccaaagcatcggcctggagacctttttcttttaacaaacgccaaaaagccacactgacggttaaaatggctggctgcgtatattcagtttgattcaaacggtcattttcagtaaaacatagttcagtcatatcatagccgagcatctcacttgcttccgtaaaggtttgttgaacacttgattcttgctgatataactcctgacccattcctacatattgggctccttgaccgctgaataaaaatgctgttttcattttaaactccttttttgaactgaaagattttggagaaaatggcatcttcactcgcagatctcagcgagtgaaacacactctttctattacaaggaaaggctaggctgtttgcctagcctcgttttttatgcttgttgtttttcaacgtatttaactagatcttcgacagttttgatgccgtcttcagtttcgatttttacatcgaattcatcttcgatctcgttaatgatttggaaaaggtctaagctgtctgcttcaagatcctcttgaatgtttgtgtttaatttgatttcttctttttcttttcctaattcttctgctacgatttcttgaattttttcgaataccatgtgtatattcctccaatgtgttttcttcaatattgattgtgaacaggctataaagctgccagcatggtcccccatgctaatccgccgccgaaacctgagaacaccactttttgtccgctgcctaaagacagcgtgccgcgtttcacttcttcatctaacaaaatcggaattgaagcggctgaagtattgccataaaattgcatattttgcaaaaacttatgtcgcgggacctttaatttccgagccactttatctaagattcgggaattggcctgatgcaacaagtaataatctaccgattcatgctcactgattgcatgaatggattgaacgacatcgcgtgtcgcaaaatcaaaaatttcacgaccaaccatctgcatacaagcactgtattggattgacgaacttccgtaaggattcttattttcaacaaaacctgatgtcagagagagtcctctggttccatcagactgcatcgattccttcaagagatgctgatggttggttgcttctaaaagcaccccgcctgccccgtctccaaataaaactgcggttgaacgatcttcccaatccaagacctttgacagcacttcaccgccaatgacgagcccttttttagaaccggtccgaatcaatttttctgctaaagacaatgcataaacaaatccggcacaagctgcgctgatatcaaaagcaaaagcttgatgggcgccaatattcccttgaacttggcaagcaactgccggtgtattgaaatccggagtgatggtcgctactaggataaagtccaattcatctggagcaagtccccttgatgccaaaagtttcgtagcaacattcgtacataaatcggaagtattttctccattactaattcgacgttctttgattcctgtacgtgaaaaaatccagtcatctgatgtatccataatttctgaaagttgctgattcgtcacgatttgttcaggaacatagcttgctgttgcggtaatctttccaaacatattcatccgttacactcacttataatcttgtaaaaagtcatgcagattttttaaggctttaagtaaagcttgctcttcatccgtagacatctggcttagaacgcctttgaccatctcacggtgaaaatgttgatgtacccgataaagcaatttgcctttttttgtcaacgcaagtttgactacgcgtcgatcgtcttcactgcgaatgcgttctacatattcttttttaaccaaacgattgattgcaatggtgagggtcccaacagtaatagaaagctctttagcgacttctgaagttgttttcttcttgtacatgccgattgcttcaatcgtatgcatttctgtgattgaaagatctttaaattgtgatttctttaattctgattcttcgatcacgagaatgtcattgaagacactgactaaatagtcgttgaccgtttctaaatttggttccatatctttcaccatccgaatagtttgataatcaaatcatttgatagtcaaactataaagtaacttttagagaattgcaagaaaattttttgatttttattttttttaagcgcatttttattttcagtacgcttttctaaccttcacaagtttttaagttgacaattaccagagaatcgagtagttaaaaattattttgattatcaaagatttcttccatcatttcacgaaaatgattatcgtgtcagaacatcacttgttctacaccttaatttttggtatcgttgcagtgtagaaacgaggtgatggacatcaacgcacggatcgaatacttaaagcaaaaagcaaatgcgttaccccaaaaacctgggatttatttaatgaaagattctcatggcggaattctgtatgttggaaaagccaagcaattgaaacaacgagtttcttcttattttcgcaaaaatacacagcatacaaacaagattctgcgtttagttcacaatgtcgtagatttcgaaacaattttcgtagacacagaactcgatgcgctattgttagaatgtcagttgattcagcaacatcgtcccatttataaccgtcaaatgaccaactttcttaattaccaatacatccgctttgatgcaggaaacatcgttcgaacaaatgaggcagcagaggatgcactaggaccttttcgccgatccaagcaattgccggaaatcattgagatattgacagaaacgtatcaattaccttctgtcaatccttataaacttctctcgttgtccaaacagttgccgttaatgcaaactattcctttggaagaaaaactgaatgagctgaaacttttctttcgtgcagaaagcaagacaatatttcgttatctcgaccaacgattgcattattttgcggaacagttactttttgaacaggctggtcaactactgtaccaaaaaaaattgcttcaatccttttatcgagaaattctcgaggtgaatactctgatcgctctcccagaatttcgctttgagattcctcttgaaacctctcttgaagcttctcttgctgccgattcatcacaagtaaaagtctatcaactctcttttggacaaatcattcatagcgaagttgtatcaacctctgatgcttttgttccagcacctttaacaacagctaaacgattgctgccaacagaccttgaccctctacatataattttgcgccagttaagacaattaaattttgtgctgtcaaatacctaaacgctcaaatgattgcaacaaaaaaccagcgctccttaaagaggaacgctggcaatgcgtatggcatttttcatctgaacgctgatacgtttattggatcaaatcataaatttccatggctacaatatcaatattatcaaattgataaggctgacttgactctgcttccgttaactcaaacgtttctgtggtgttatcgtaggtcactgtgcatttttctacgccttctttttcgaaacggcgaacttgaacctcgttgtcttgcgcttcgaccatcgcttctaaacgtttgatgatagcgactaattgcgaacttttcattcgtaagcctcctttttctgtccgttatattgtatcaaatcatattctatcttgcattgattttttacaatttattttgtcattttaagatttttttccatcttgccaccaaagcttaatcagggcttgagtcccatcactttcatagccagcttccgctaagcgatcgtacattttttttgccaaagccgtacttggcaaatccagtcccattttcgctgcttcatcaagtgcgatacctaaatctttgataaaatgtttgacaaaaaaaccaggtgaaaaatcttctttcaaaatacgggggctgtagttggccaatgaccagtttgcggcgctgccaccagataatgtctcaatgacttgcggaagttctaaacctgctttatcggcatagacgagcatctcagtcattccagtcatcgtgccagcaatcatgatctgattggccatttttgtgtgctggcctttgccggcagagccatgaagatgacacgtttttccgacaatctcaaatagtggttcaactttttgataggcttcctcgtcaccacccgccattatcgtcaacgttccattttttgctccaaggtcaccaccagaaactggcgcatcaatacttgccgcaccatgctcttttgccgtttgatagatttgttctgctaattttggcgtactagttgtaaagtcaactaaatattttgccgcgacatcggtttgaaaaattcccttttctccatagtaaacttcctcaacatctgcaggatagccgaccattgtgaaaacaacttcactttcagcagcaactatttcaggcgtatcacaccaaaccgctcccttagcgactaattcgtctgttttgctttttgtacgattatacacatttacatgatgtccgcttgctaaaaagtgaccgaccattgattggcccatgacacccgttccaataaaacctagcttcatagtcatacctccaaaaataaaaaaattcacgtctttagtatacgctaaaaacgtgaacttgactgcaataatgtttaatcaattgttcgtttaaatgatttcaatttgactttgaattttttcaatgtttcttcggtttccttgtctaggcgttctgtctcatagtaagcaatcatatcatggtaaaaagaaagcatcgattcaccaaagtgtgccgcagagatttcatacatttttcgtgctaagacactttcattcctaggaatctgctgttgataataatgaataaatgcagaagcaaaatcttgatcggtgtcaaaggtcacaccaagagatggatcatcgatcaatgtatttaaataatcattgccttcaacgactaaaggcgtacctgctgccattgcttctgtatacgtcagtccttgtgtctctgaagtagaagcactgacgaagaaatctgctgcatgataatagatggctacttcatcatttgcaacctctccaacaaaatgaacatggtcagacaagttcatttcttgaactttttcttccaatttttctttgtaaggccctttgcccacgatcactaatttggctgaaggaatttctgctagaatatcaggcagtccatcaacgatcgcttggatatttttctcataagaaatacgactcaatgataataacattggctggtcttcttcaatcgccaattcttgacgcaaggctcgtttcatttccagagtgatatccggacggcgaaatttctctacctcaataccagtgggaatgatgcgcatcggcgacacaacgccataactgcgtagtgtatcgatgacccgttcactcgggcagacaaccccagtagaatgattggcaaacagacgagagaaatactttacgtgtgtaggtcgcaaaacttttcctttcgcaatataatgcagataatcttcatacattgtatgataggtatgaatcacaggaatctgtagttttcgacccaccatttttcccagtagtcccgcaccaaattcagtatgggtatgaatcagttctagttccaactctttcgcaatcaaataggcataccacatgccccgcaccacgattctacggtctttgaaagacacgaaaggcacactaggcatacgaatgatatcttcctcatccatttctgcatttggatctgtagtcgtaaagatatagaccttatggcccttcttttccaactcttcttttaatgttttgatcgatgtcgctacaccgctcacttgcggaaaatatgtgtctgtaaaaaatccgattttcacaacggtacctccaaacttgccgtcaatcaacgggtttttcttctaaaacgctttgataaactttctttaactcttttccaatttcttcaatactccgttctgcagctgcttgatagccggcagctgacagatctggtacacgaccttctacgatgttagcaatttgttcaacgaactcatcaactgtccgtcccatataagaattttgattctcttgcaaccaaccatgataaacaggaatgtcacgcactagaactttctgcttactagcaagcgcctctaacacaacgatcccttctgtttcttcataggaaggaaagaaaaacagatctgctccagaataggccccctcaatgacatctcctttgatatagccaggaaaaataacattttcaggatggttttctttcacgagatctcgaaccgctttagggatcgtatacataggtgtatgtccaaaccaaataaaagtatactctggcatgcggcgagcaatctcaacaaaatcgacaattccttttctctcaaaatacaagccaacagaaataatcactttttgatccgccgacaattggaaatagtcgcgaaaagcctgttctttttttggttccggacgatatttgtccaaatcaatcccattagagatcgcacagatcggtaccttgatgccatacccttccaatagttcttttgcgtagggcgttggggttatcaattgatcggctcgggaatataaattgatcaaatattttttgtataatggcgataactggtttgagccgataaatgaatttcgaaaatcttcttcagtcgaatgcgcatggtaaattacctttttgccttgtttccttgctttattgatttgattcaacgaattgatcccatacgtattaatatgaagtatatcataatcctcagcttgtttgtctaatgtatattcaacaccgatactgctcagtgcacgttgctgatgcgcaagtgctctgccgataccagatttctctaaaagcttttcactttcaaaatagagaagtactttcaaacgagattcctccttctaaactgttacatctagtataacatagctagacgagaacaccctccaactcaaggcctagtttttgtattgatttctatcatacgtcaaaaagctggtttatcaaaggtcatcaaaacaatatgacaaaactgttcgctcccagaccacaaaaaaagcagcaagcgaattcgcttgctgctaacttttaactactttacatattgattgatcaattcgactacttcttccatcgtatcgcaatcttccaaagcacgttttgctaattcttgcatgtcagttgttgacaagcgtttcattaagctccgtgttttaagtacagaagttgcgctcatagagaattcatctaagcccataccgactagaagtggcacagcagtttgatcgccagccatttctccacacataccagcccatttaccttcagcatgtgctgaatcgattacgtttttgatcaaacgtagaatagatgggttatatggttggtaaagatatgaaacttgttcattcatacggtctgcagccattgtgtattggatcaagtcattggtaccaatactgaagaagtctacttccttggcaaatttgtcagctaagacagctgctgcaggaatttcgatcatgatacctacttgaatatcttcagagacagttacgccttcatcgatcaatttttgacgttcttcttcgtacatttttttcgcagtacggaactctttcaatgttgccaccatcgggaacataatacgcaagtttccgtgagcagaagcacgtaacagcgcacgaagttgtgtacggaacatgccgtcacccaactcagataaactgatacgcaatgcacgatagcctaagaatgggttcatttcgtgtggcaatttcaagtaaggaagttctttgtccccaccgatgtccattgtacgaacaacgactggtttaccagccattccttcaagaactgctttgtatgcttcatattggtcatcttctgtaggaaaatcaggagaatccatgtacaagaattctgtccggtataaaccgacagcttctgcaccattgttgtgaacaccttcaagatctttaggcgttccgatatttgcagctaattcaaagtgcttgccgtcagctgtaacggtttgagcatctttcaatttttcccattctgctttttgttccgcgtaagctttccctgcttcaataaattcagcagcttggtcttcagtaggattgatgataacatctcctaagattccgttaactgccagaatatcaccagcattcactttagctgtgatttcttttgatcctacgattgcaggaatctcaagagatcgagccatgattgctgagtgagaggtacgtcccccgatatcagttacaaaagctttaacgaagttgcggtctaattgcgcagtatcacttggtgtcaaatcgtgagcaacgataacaacttcttcgttgatcattgaaggatttggcaacgtcacatttagcaaatgtgccaagatacgtttcgcaacgtctttgatgtccgctgcacgttcttgcatgtatgcattgtcatccattgcttcaaacatgccgatatacatgtcagtgacttctttcaatgcagcttctgcattgactttgttatctgccatgttttgtttgatttgtccgatcatttcaggatctgacagaaccattaaatgagcatcaaatacttgtgcttctgcctcgcctaaagattgcgctgctttgtcacggatttgttgcaattccgctgttgactttgctagagcttcatctaaacgagcttcttctgctgccgtatcttcaacatttacttttgaaaaagataaatcaggttgtactaacaggtaggctttggcaacggctacaccatcactagcagcaattccttttagcatctcaaccattattcagacaaaccttcttttttcattgtttcaacgattgcagcgattgcatctgcttcgtcagcaccttcagcagtgattgtaacgtcagaaccttgaccaacacctagagacataacgcccatgattgatttaaggtttactgatttacctttgtactccaagttgatatcagagttgaatttgcttgctgtttgtactaataaagtagctggacgtgcgtgaatccctgtctcagcaactacgtgaaaatctttcttttccatattgatcaatctcctttatgatacggtttttttgtggtgaaggctttttttgactcagtcaattgtcagactcaaaaaaacgccctttcaactgttaagattaccatttttttctctgatagacaaccgttttctcttaagaaaacgactgaaatgaacctatatttgtttttatggttggtaccgatagatgatcttgccattcaagccagcctcgccgacaaatttcatgcggtcttccaattttaaccatgcttctcgaaatagcagaaattcggattgttctaccagcaattcgtcgatttctccagagcgcaactgttcaatttgttcaacaaatcgattttcattcatctctatcacctcttcatcttctccattataaacgattcttttttcagggaaaagttgtttccgtcatcaaagctgaaatccttgcagtctgaaaaaaaaattgtataataaagttatggtcagtaaaggtcaatgaaatttttgacgctgctgacaattattcaccgaatctgcaagtgtatctttttaccatgagtaaaaatcgcggtagaatgatagatgagcaaatgataagaaaggtcgtgaacatatgctttgtcaaaactgcggtaaaaatgaagcttctattcatctttatgccaatgtcaatggtcaaagaaaacaactcgattattgtcaaagttgttaccaaaaattaaaagcacaatctggaaatccaacaaatatgatggctcaggatcccttcggcttcggaaatcttgatgacctttttcgacaaatgtctcgccaaatgcaacaaggaaattcaccttatgaacaaacgcctccaactcaaactggaggaaacggcataatcggcggacaacctccgcgcaatggccaagcaccttctggtcttttaggcgaatacggcatcaatatcacacaacaagctcgagacggcgggatcgatccagtcgtaggacgtgacgatgaaattcgtcgggtgatcgagatcttgaatcgccgaacgaaaaacaatcctgtattgattggtgagcctggtgtaggtaaaaccgctgtcgtggaaggtctggcacaaaaaattgtcgacggtgacgttcctcaaaaactaatggataaagaagtgattcgcttagatgttgcgtcactggttcaaggaacgggtattcgcggacaatttgaagagcgaatccaaaaattgattgaagaaatcaaacaagccgaaaatgtcatcttattcattgatgaagtccatgagatcgtgggcgcaggggctgctggtgatggcaacatggacgctggaaatattctgaaaccagcattggctcgcggtgaattacaaatggtcggcgcaacgacattgaacgaatatcgcatcattgaaaaagatgcagcattagaacgtcgtttgcaacctgtccgagtcgatgaaccttctgtagaagaaaccatcagtattttgaaaggattacagcctcgatatgaagattaccatcatgtaagatatacggatgaggcaatcaaagccgctgctaccctttccaatcgctacatccaagaccgtttcttgcctgataaagcaatcgatcttctggatgagaccggctcgaaaaaaaatctgactattcaaattgttgatccgaaaacaatcgacaagaaattgcaagaagcagaagaacaaaaacaagctgcttctagagaagaagactttgaaaaagctgcttactaccgagatcaaatcaataagctgcaaaaaatgaaagaacgtcaaatcagtgaagaagaaactcccgtgatcaccgaaaaggatatggagcaaatcgttgaagaacggacgggcattccggttggcgaactcaaagaaaaagaacaaactcagttgaaaaacttagctcaagatctgaaatcgcatgtaatcggacaagatgaagcaatcgataaagttgctaaagcgatccgtcgtaatcgtgtgggattaggaaaacaaagccgtccgatcggttcgttcctttttgtcggaccaactggtgttggtaaaacagaacttgctaaacaacttgcctatgaaatgtttggctctgaagaatcaatgattcgttttgacatgtcagaatacatggaaaaacacagtgtctccaaactgattggttctcctcctggttatgttggttatgaagaagctggacagttaacggaaaaagtccgtcgtaacccttatagcttaattcttttagatgaaatcgaaaaagctcatcctgatgttctgcatatgtttttgcaaatcttggatgacggtcgtttaactgatgctcaaggacgcacggtcagcttcaaagacacattgatcatcatgacaagtaatgctggcactggaaaagtagaagccaatgttggttttggagcagcccgggaaggtgtcacacgatctgtcttgaatcagttaaataactacttcacaccagaatttctgaatcgctttgatggcatcattgaattcaaagcattaagcaaagaaaatctgttatccatcgtttctttgatgctcgcagatgtcaatcaaaccttagccaatcaaaaattgcatattgaagttccagaaaatgtccaagaaaaattggtagagcttggttatagtgctacgatgggggctcgcccattacgccgaacgattcaagatcatatcgaagatggtatcgcagaattttatcttgatcatccacaagtccatgatctacaagcaactttggattctgaagacaaaatcattgtgacagcaaaaactgttgacacaccagaagagccaaaggaacaagaaaaacagccatctgatgatgagtaaaatcctcgcaacagccagacatcgtaccttatttgtctagatttctatgccagacgcctgaataacctcaaaaaaaccaaggttttcaagctgtctggcttttctttttaaaaaaaacgccctataatattagtaaaaatacatagaatgtgaggtgagtatggtgaaattgatcaatgtgacaaacagccattctcgattagttatgaatcagcttgaaaataccgatgctgaaatggtaaaagtatatactgccggagacatcacagtcatctttacttctgccccaaatcacaacgaaatattgctgatcaacaaaaaacgtgcaatcaaacctaccgaaattgaagaaatcaaacattacttcttgaaaaaattaccgcctggttcttatgaacctgaaacgatctcagttattgaaatgccagatattgtagaaatttctatccaaaaatcgctttcttcgcaaacctaataccaatgaaatcactataaaaaaatatctataaaagatgactgtcacagccctcttttatagatatatttttttgacttatttatcgttgcccctgcgaaacaaacaatctttaagtaaaagcatctgtgccatgactcaatcaacagatcgatcctaactaatttttggggggcactttcagatcgaattcgccgttcgatgatcctcccattgataaatatccctaaccttttccatgtttcactgttatggatatcctcaagaaagaaaaaacactgattcttttttgattcaacaaatcgatcagaaataacgatatctgcttctgcaaggttttctaccatagttacagtttcctttttatatacacctgttatataattttttactaacattacatagttggcatgagaggtaatattaatcatgacattcaaaggttccgccatcacatgtccaacataggagtatagtagctctgttagttgtgtactaaatatatccaaatctctttccgctatgctttttttgtaaactgattttatcatctcttttatttttagaaacttatcgttcaacaacaatttcttatcttcgtggtaaaagaaggaacttaaactcagcttatccgtgatcaaaaaacgatatacaagatgaaaaacaaatgtgctatgaaggttggcaggaatactgtaactctcctccattttcttcaaagcttcacatgcatgatctacgataggctttccagataatttcattaatcgcttctccaatcgttcgcagatttcagatgtcaaatattctggaaagaaataaatagcgaaaagatagtaaaagaatttttctgactgataaatagaatgattgatctttttatctaacggataaaaagtctgacaaaatcctagtcggatttcttcatataaacagtcgcttatagccgtctcttcttttgaatctatatcagtataacttcctattttatgggcatccataaaaactctagttattctagaaagtttctcttgcttgatcctcgttacattcttttcgttatgatatctataataattgtcctcagcaaatgtcgaagaatgtgtattcagaatataggaaagtactcgtatctggctttccttaccttccacaactaaataattcattttcttcctaatctggcaatcgactccaatcgttcgaatgatatcggttgctttattgactaatttgtaacaataagactgactataattaaattgcattgataacttgaccatccctacttttcgatgtttaagaaagtaattcaggacttggaaaacagaactttgtctaatatactgtatctttaaacttgaatacaaagacgtaaaagtttctggggtctctatgtcagaaagtctaaataatctattttcaaatttaaagagtgagtcggttatattcagttctactatgtaatcctcattgatctgcataatcaatgacttcaccttgcgattagtcagcgaatgcttacaagctagttcatcaattgatgtttcagtctttgaaataatatcctctaacaagtttaatttttgttcttgcctctctgtcagaaacaacttccataaatccatgatgctctcctttttaatgatagttacttcgataattttgtctatctctgaaacgaaacaattattaagtacagttacctattggggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccatttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcgacggttttccgctttaacggaatatacgttgcgtccatataaatagcagcataacggtcatgaagctcccgccctttaaacgccgttacctcttctgtaaatgattttgttatattggacatggtttggggcgtgtagtaatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctctccaatttaccttcaattggtaagagttttacgtacttctttaaatcataatctttatttagcaaattgtttgtttccgcaacataagtcattgaagtcctagttgaaacagcgatactaggaaaaaccgatacttcaatggcatgactttcatgattagtaacagttgctgtataagtatacttttggttcagatcaggcgaaaattgaatatcttttactatacttgaattcttgtctgcttggatctgaacttcaaaagaagagccaatcgattcttcggccaatgcttctggactgaaaaaaaatattcctaagcacaggaacaaaagaaacaccctaaaagaataagattcattcttgtagctaggatataacatacgattaaggagtgacgtctgtcacttctgatgcagttagtgtgattacgtaatcacttgccttagtgttgtcaaaagttgaaggatcaattgtataatcaaaagtaccttcttcagtcgtttcatagccttgacttgcttcaactttgaatacttcactcgttgcaatcgttaaaccaggtgctgaggtttctccaggaactgctgctgttatcactacttgctttgctccaaatgacttattcgttaatgttccagataacgtgaaagtacctgttagcggattcgctttcgtttctgtgaaactaatatctgcaaaatctacagtttttgtttcaacaggagtagctaaagtaaatgttgctgctccttctgtgacatttacagtaactacttcaaactatttgaattcttacagaatagttttgccaaagaaagtgccggagcatatgatgccggaaacaatcaactcctttctgaatatttaagtgaccattcaccggatgggaaaatcattttcttagcagctaatcctgatatacctatcaaagggctcggaacgcggctgctaaatgaactacagaaaagagtgcaaggaaaagaaatttatctttttacagatagtgcttgtacgtatcaattttatgaaaagcgcggttttcaacgtcaaaaagaaaaaaagatttcattaaaattgcccaacaaaaaaattgatcttcagtgcatgctctatagcaaagtgattgacaaatgatagccatgctacgcaacaaaaacgtttttcaaatgagtgcaaaaaagcacagccctaatggctgtgctttgctaatgattggaataaaaatttatcccctgttcggtatcttctacataactatgcgctggagctttagtcactaaataacaaaaataaaaatccccaatacaggctgacccatgaaaagaagccaaccagacaaatgcataaggagaaatttccctatacgcatacaacagccataagaccaaagtgatcaagacaaaaggagcaagcaaaataagtaaaaactgccaccttgaataaaaggaattaggacttgttgcataggccaaaccattcttaaaaccaaatttgacttttccttccttattgaacagcttaaaaaaaatcccgtgaatcaattcgtgaacgatgattaaccctgccattgatagaatggcaataacgagatacattaaatcgatagtgacttcttccgttaactttctatctaatgttaaaagcgtaaataaagcaaagaaaataaccaatagaggaatcgttaagatattcagtttcatgattagctttttatcgtcaagcaaattgacacgcttgattaatttcataatgacccccttactcctatttgcaacactataagcgctcgtctcacgtcataaattattatatcagtttttttagaccaaaacaattcgattttttactgatacaaaacaaaaaaacattcttatcaaaaacgataagaatgtttttttagacaagaaccaactcatttctcgctcccatcatttgagaacacttgccgtcacaagtactagcagtgttttcacatcaaacttttcaattcgacatctggatatttgtcggcgaaccaacgcatcgcgaattggttctcaaacaagaacaatggctggtcgaaacggtctttggctaagatgttgcgacttgaactcatcttttcatccaaatctttaggatcgatccaacgagcaatcttatgtcccattggcgacatgatcacctctgcattgtactcgttcagcattcgatattgaaatacttcgaattgcagctgtccaaccgctccaataatgtattcatcactgagatacgttttatacaattggatggctccttcttgcactaactgatagatccctttatggaatgatttttgtttcataacatttttggctgttactttcataaagagttcaggtgtaaacgaaggtaattcttcataggcgactttcaatttcccttcatataaagtatcaccaatttgataatttccggtatcatataccccaatgatgtcgccggcaacagcttgctcaatattttcgcgagtgtctgccatgaactgggtcacattacttaatttcatttttttgcctgtccgctcaagcgtgacatccattccccgttcaaatgttcctgagcaaatgcggacaaaggcaatccggtcacggtgtgcggggttcatattggcttggattttgaaaacaaatcctgaaagctcttgttcgtatggactaatttcttctcctgtccttgtcttatgtccgtaaggtgctggtgcaaattgtaaaaatgtttctaagaaagtttgcacaccaaagtttgttaacgcagagccaaaaaagacaggggtttgatcaccacgagcgattttctcttcatcaaaggaatcgccagcttcttgtaataattcgacttcttccaacacttgttgatagacaccattttgattcagcggatgatcttggggaatttcaccgttttgattaaatggaatcaggcgttcaccgccatgagattctggacgataaatttcaacccgttgattgtgaatgtcataaagtccttcaagcccttttcccattccgattggccaattcattgggtaggactcgatttgaagcaactcttctagctcttctaaaagttctaatggttcacgaccatcacggtctaatttgttgatgaaggtaaagatcgggattccccgtttttttacgacttggaaaagctttttcgtctgtgcttcgatccctttggcactatcaataaccatcacggcgctatcaacagccattaacgtacgatacgtatcttcagagaaatcctcatgtcctggtgtatccaaaatgttcacacgttttccttgataatcaaattgcattacagaactagtgacagaaatcccccgttgtttctcgatttccatccagtcggatttagcaaaattaccggttttctttcctttgacagttcctgcttggcgaattgctcccccaaatagcagcaactgctcagtgatcgttgtcttcccagcatccgggtgagaaataatcgcaaaggtgcgacgactttcaacttgttgttttaaatttggattctccatgttatgtagttactccattccttgaaattagaactctctgtgtctatacaaagattttctgaccaaatcagtatatcatgtatcaagagcggaaaaaagaaaaattacagacaaatgctctctatcattcagattcgaaagtctagagagcaactgtttaagcagcttgatagctatttgtatttatacgagaactgctgtgaaagcatgaaaaacactcaaaaaactaaaaggctggaattaatgtatcactatgctcattttccaaaaattctttgactttatcgctggtcatcgcttttcgcaaaacattgattttttctgaatcttgattgtccttacgagcaactaaagagatcgcaaaacgatcatctatcgttttctctaagaacaaggcatcgtcaggctttagaccaattttggcgatataggtcggatagttgtagacaagggagacatttggttcattataggcttctgctagattcaataagtccacagacaaccattcaaagtttttaggattcgcagtaatgtctttgatcgtaccattgactccaactccatcttttaattcaatcaatccttgctcagctaagatggctaatgctcgtccttcattagaaacatcattcggcagagcaactttcgttccttcaggaatgtcttcaatttttgtatactcttttgagtaaaagcccactttagcattataaattttgtctaaagccactaaatctgctgatttttcctcattgtagcgttgcatatacggctcatgctgcgcaaagtttgcgtctacttccttattattcaacagctcattgtattgaatattgtcatttacttgtaccaattcaattttccagccatcttctaccgcatcggctgctactttgacaacatctgtcataggggtcgtttgagaagcgactttaatcactttatcctctgattgcgactcattccctgttccacaagcaccaagaaacattactgctagtactaacccaaaaaatattccttttttcattcctactcctactttcttttatcaactttttttgctaacccattcccaatcaactgaatactaaaaactgctacgatcatcactaaaatggaaaaatacatgaccccatattcgtaccgttgatatccataacggatggcaaagtctccgattcctcctccgccaacgattcccatcactgtggaataagacaccatactgacgatcgttgtcgtcagagacaggattaacccgcttcttgcttccacaagcaaaaattctttgacatattgataagtggagacacctaatgagcgtgccaatagtccgacatcttctgggacatccaacaatacctgctcgactaaacgagcatagatgacgattgacacaatactcaatgggatacttgctgggatcggcccaaacgagctgcctaacaaaaaacgagtgacgggaatcatcgcaacaacaaacagtaaataaggaaacgaacgaatgaccgtgatcagcaaatttaatatttgatacaaaatcgttccctgattgttgttttcacgactaataaataatagaatacctaatggcaatccaatcaaaacagcggcgaagatagagatactcatcatgatcagggtttcttccatcgcctgcatcaattctggtaaatagtattgaatactctcaattatcgtcatgctttagactccttatcacacgatcgacatagtttaattcttctttttgtaaaagatgcggcgtattcgctacttccgctacgattcttccttgttccataacatagacccgctcacaaacttgtcgaaccgctgacaattcatgactaacaaacacgattgtaggctggaaagtgccatgaaccttttgcaataacgataaaacatctcccttagtatcttcatccaatgcactggtcggttcatcacacaagaggatctttggttctttgaccaaagcacgggcaattgctactcgttgcttttcccctccacttaaagaagcaggataaaccgaagccttttcagacatacctacgaagtctaacgtttccatcacttgtcgttgtgattttccagctaattttaaaggcaaaaaaacattgtcgtagacagtcagattatggagcagattaaattgttgaaagatcatcgcaatatcttgctgtagacttcgtctcattttcttggtcaatcctgtcgtgttcacgccatcaatcacgatttcgccagctgaaggagattcgatcaaattaatcagacgcaacaaggtagacttcccggaaccgcttttgccgacgataccgacgatctcattgctgattgttaacgatactcgatcaaggacattgtcctgatatacttgtgaaacctcttttacttcgatcatatttggttcctgacgctcctctgccttcaaactcaattgaaaagtagtgatacaaattgctcatttgtcagttgatggatatatttcgcgacttccatcccttgaaaatgctgccgcaactcttcattataaggaagaccaatcagctgtttttcgagaccagcgatatcttcttcgccaaaaaaatctccagtgatttgtgcttctgtgattttcccctttgccactgaaaagcgtagttcaacgataccaacattttcaaaacgtttgcgtttcgtccattgataattcggggcttccccataaatccattgatcattggcatatcgcaattgatacaactgattaatcttccgttgatcttcagccgttaatttgatttctttttcttggatttcctcaatgttgtcgacgtcataaatatgacagagcaattgatctctaaattctttcgttgacaattgttgatattcttcagaaagataaggcttgatgttggtcacacttttacgcactgactttgttgccttcgagtcgatcttttcctgtggaacgttcaacacttttgtcaaaacgcttaagtcaacatcgaacatcaatgttccgtgggaatagcttctgtcattttttgtgtacatggcgttaccagaaaatttctttccttcaacaaacaagtcatttcttccccgtacttcaacctcttttgctcccatcttctgcaatgctttcaaaataggttgggtggctccatgataatcaccaaaatgagtcacatcttttttagtcacaaagctaaaactcatgttgcctagatcgtcataaactgctccgccaccagaggttctccgggttaaaacgatgtcattatgtcgtaaatagtcaaaatttatttcttcgtaggcattttggtttctaccgattataacacaaggcttttgtatgtataacagcaagcatggttctgaaatatctacgttattcattaaatattcttcagtagctaagttcatccgaatatcatcacttttcattcggtaaaatctcattttcccaccccacaatgatttctagttatcgcactcttatactctctttaattcacaagaaaagcaagaaatatgcttagttattttagtttttttatctagctaaatctgtatcatttgattaactcattctgttatatattatttttagacaaaaaaatgcttgaagcatttgcttcaagcattcattttatcgacgaggttcgtcttcttcaaaatcttttttgaaatagcggcgttcttcttcaggttcgacagctgtttcttcaggatcatggaagataacgcggatcttcaatacacgtgacccttccatttcttctgtaatcagtgtgacgttatccactttaaaggataatttctctccttcatcaggaatcaaccctaaagctgtgatcaaatatccggccattgtatcaacatcactcatgtgcaggctcatatcaaatgcttcattaaagtcatcaatcaacattcgcccttggatgatgtactcatgatcagaaacttgttcatataattcttctacttcatccgattcatcgtcgatctcaccaacgatttcctctaagaggtcttctaaagtaaccagacctacgacaccgccgtattcgtctaataagatagccatctgattttgagtctttttcaactcatagagtaagtcatcaataaaaacagtttcaggcacaaataatggttcttggaggatttgtttaatatctaatgtttcaaatccatatttataggcacatttcagcaggttttttgtatgtaaaatacctacgactttgtctttgtcctcattatatactgggattcgagaatagttttctgctaaaatttctgtcaaaatttcatctactgaatcattgatatcgaccataaatgcagtagtccgcggcaccatcacttcacgggccaccttcgtatccaatgaaaagattccttgtagcatttccaattcatcttcttcaaagacaccttctgtttctaacatataccgcatttcatcacgagtcatttttgtatcttcatcatcaaattccattggtgtgattcgagctaacaaactagttgaagcggaaagcaaccacacaaatggttttgcgatcgtaccaatcacacgtatcacacctgaagtaaattgagcaacttcttcagatttgttcattgcgattcgttttggatacaactcaccaaatacgatcgaaacataggtcaaaatcgctaatacaatgatattagccaggctttttgctgcagctccgccacctagaacgggtgctaagcgggtagatagcgtatctgccagtgaggcccctgataagatattgactaatgtgatcccaacttggatcgtcgacaagaagttggtgggattgtcaatgattttcaataatttttgtgatttgacatttccttcctcagccttctgttctacacggttcttattaactgaaacaaccgcgatttctgaagcagccaagaaagcattgatcaatgtcaaaacgatcaataataaaatttgcgctaatagcgactgactctcggggtcagcattcataatagcattctctccttatttttacattttctaaaaaaaatcgtgggctatacccacgataaaatcgtatcataaagcttttttctttgcaataaaaaccatcagttatctagttcgatcaatttctcttggtttttcttgcttttatcgtcacgaatcaaacgaatcacaaaaatcacaatcgtacgacaaatggcgtagaaaggtactcctaagaaaatacccagtaatccagcgatgttccctgcgactagcaacactaaaataatggttagcggatgaatcgccaatgactttccgattacattaggatagatcacattaccatctaattgttgaacgactaacacgactacaccacataacagagcccggaaaggatcatcaaagattgtcactaaaactgccggaatcaagccgaggtaagggcccaaataaggaatcaagttagtgatccctgcaatgacaccaaataaaaaggcgtaattgacacccactagccagtagccgataaaggtaaaggtcgcgacaaaaatacattcaatcgcttgtccgctaatgtaattggacaatgttttattcagatcacccaataactcgatgatttgatttcgtcttttttcaggtaaaactgattgaatatttggcacaagtttctcgccgtctttcagcatataaaacaagatgaatggtactgtaacaatgatcatcgttgctgaagcaatcgttcctacgatcgatcccaaacttgttgacagcccacttagaaattgttgcagcaatgaaccataggaaagattgagattttctaactgttgcgcaaagtcgatctgtttaaatactgggtcatctgctattttagaaatccaagtctccatatttttagcaaaagtaggaatattttctgcaagttgtgaaatttggttgatcagatttggaatcacgcttacgactgttaggacaatagctgctactaataagagtaaaactaaaatcacagcgtagattcttttgatcttagtggtcttcatcagaaaaacgacgatcggattaagcagatagtacaaaaagcctgcaattaagaccggcgcaaataatgtcgaaaaaaatgttcctactggtgcaaataagaaattgattttgctcaataccagagctaacgtggcaagaacgagaatttctaatgaccagaagaaaagttttgattgtttgaatttgtcgaacaaacgattccctcctttttttcactattatagagtattttgcaaaaaaaagcttgcgactttagccgcaaaagcaatttttcttttcgtaaaaatggtatacttagaaaataattgatgaaataagaaggtggttgattttatgttcgtcgcacaaaccaaagatacattaagcgaaatttatctggactcgttgaaaattcgtaatgatgtcttcgtcaaagaacaaggcgtgcccttaagtcttgagatcgatcaggacgaagcaaacgcggtccattttgttctctacaatgaacaaaaagaagcaacagcaactttgcggctgcttcctatagatagccacacattgaaacttcagcgtatggccgtacccgtttcccatcgcaaaaaaggcttcggacgaattttgatccaaggggcggaggattttgctcggaaacaagggtttcaaaaaatcactttaggtgctcagctaaccgcaaaaggtttttatctttctctaggctaccaacctgaaggggaagaatttcttgatgcggatatgccccacatcaaaatgagtaaatatctgcagaactaagtatcttaaaagctgtcaatcacttataactcacgtgattgacaactttcgcttctttatagaactggatgaatctcctttaaagaagccccgccttacaaatcaatcactcgatgacaggcactattttttgatacaaaaagactcgacttcgaattaaagtcgagtcttttgcacattgaagtgaccctttacggctactccttgctatttctgagacaactgcttgtagcgatcataccaaatgtccacatacccctcagaaaatggtcctttgccattattgatccaatctactaaaattttgacattttcttttaaaataaaatcaatgtcctgcggataatgcatgatcttgctatgaagctcatattcatccacatctagtaaacgtttctcaccatcaggaaatactttgatatcaaggtcataatcaatatatttcaaggcctcttcatcaagcaaatacggtgaagcgagattacaataataggaaacccccttttctcggatcattgcgattacattaaaccagtattttttatgaaaatatacaatagctggctcacgggtaacccagcgtcttccatccgattcagtcaccaatgtatgatcattgacaccaatcattgagaattcgctcgtctttaagaccatagtatcccgccacgttcgatgcaaattgccgtcatgtttgtagctttggatgctgacaaactctccttcttttggaactcgcatagcaacccttccctcagcaagaaaacttgcgttttgtttgggtgttcattacaccgatatcgtaaatattatagcaataaaacaaccctttgcctagaaatgtttatcgactttatgatttttcttcaattgttcgactaatttcaactgaggtttgggaaagacatactgttcaaattcttctggcgcagcccattgactgtgttctaacgagaattccgacggtgtgcgtccataaaaaagcagtatgtgccatttcaaatgactaaagatgtgagtaacctcaccaagatgtcttttttgccaaacgacgggaaattcagggaaaatcggagctggttcttctgcaactgcatccaatgttaactgttggtcttgccaataagccaataattgcatataggtcgcctgatccacttccaaaagcggaaaatgccacattttggctaacaagccagtttctggtcgctgcaccaataaaaagcggccatcttcttcaatagctccagcaatgtaatacatatcttttggcttcgctttttttgattttacgggaaagtcggtttgtgttccctgctgataggctagacaatattcttgcagtggacattcctcgcataatggcgaagtcggcgtacaaatacttgaaccaagatccatcaaagcttgattgaattctcctggctcatcgtgagaaatgattgtacgcattgctttatcaaagactccgcgagaacttgctttagctatatctgcctcaatacaaaacaaacgactcactacacgcatcacattgccatcaattgcaggttccggcaatccaaaagcgatactgccgatcgccccggcagtgtaaggaccaatcccctttaacgaacgaatatcagtgatggtctgtggcatctctccatcgaactctgccatgatttgttgagcggcagcttttaaattgcgtgcacgagagtaataacctaatccttcccaagccttcaaaagcttctgctcttctgcaccagctaaatctttgatggttggaaattgttccataaagcggtaataatagccaatgacggtgtccactcttgtttgctggagcatgatctccgagatccagattgcatagggatcgttggttgctctccaagggagattccttttttcatcatggtaccaattcaaaaacttgtcttggaaagaacgaatgtcctcttttgaccacttttcccactgtttattcatccataacttcctcatctaaaaattgttggatcgcatccagagcgaaacctttttggtaaagaccttgtttgattttcatttttcttttattcaaaggcaaccgctgatgtcttcgcaaaagtcgttgaccctctttttgcaaagctgcgttttcctcttcgtcgcctctatctgtaggcagttcatctaaaattaattggataactggttgtctaaaccctttttgcattaggtgcagcgatagtttctgcatcatctctttgtgacttttcccttggaaccgacgcaatgctttttcggcagtatgatagccgacatcaaattgcttttcttctgtatataacggcatcacttcttgaatcacttcttcagacagccctttttgttttagttgctgactgatgactgatggccctttgtctcctaaacggatttgtgtccgcaagtagctttctccgtaggtacggtcatcaagtaaatttagttctttcaatcgctgcacgaccaaatggcgatcctctaaattgatttctttgtcttttagataggtacgaacttctttttcggaacgtagttgatagctaatgtaattcattgcttgctgcagcccaatatcaaaaccggagctttttttgatttcggtcaactcttcttccgtcacttcttttccttttagaagacggaaacgaaccagaagatcctcagaaacccgcaaagattctccattggagcagtctacttcgtaaaagggaccttttcccttactgatacgaatgatcgttatcattttcttcacctcacgaacgtatattctagtttatcacaaaaaaggggaaattccttcaaaagagctataaaaagtatggtaaaatagagagactatttatcgataaggagcaatcatggcaaacgtacaacttaaaaacggtcaaaaactacaactgacgatcaaacgtttaggaatcaacggagaaggaatcggctattataaaaaattgatcgtctttgtcccgcgagttcttccgggagaagaagtgattgcagaagtgaccaaagcaactccgaggtttgcagaagcgagaatgaccaaaatcatcaagaaaagcagcgaccgtattctccccccctgcaaattttatgatcgttgtgggggctgtcaattacagcatcttgtttatgaaaagcagctagactttaagaaagacttattaaaacaagcattaaccaaatttaagcccaaaggttatcagaagtatatcttaaaagatacgattggcatggaagaaccatggcactatcgcaacaaagcgcaatttcagttgcgatatgatacaaaatcaaaacgaatcgaagctggtctttacgaaatggattctcatcgtttagtggcgatcgatgattgtctcgttcaagaaaaagcaacccaagatgtgatcaatggccttgtgcagttactgaacaagtatcaactcccaatctatgatgaaagaaaaaacagcggcatcctgaggactttgatggtcagagtgggcagagcgaccggcgaagtacaagtcgtttttatcacgaactctagcaaactgccacagaaaaatgcgttgattcgagaaatcaatcaacgcatgcctcaagtagtttcgatcatgcaaaatgtccaaaacaagaagacctcggtgatcatgggggatgaaactttacatctctggggaaaagaagcgattgaagaacgattgcaggaattaacattcgacctttcacctcgtgcattcttccaactgaatccgcaacaaactagtatactttatgacgaagcaatcaaagcactggcattgacaaaaaatgaaaccgtcgttgatgcctattgtggtgttggaacgattggactaagcctcgcaaaacatgcaaaggaagtccgtgggatggacatcattccgcaagcaatcgaaaatgccaaagaaaatgcccgccgaatccaagcaaataatacgcattatgaaacaggaactgctgaagacttactccctaaatggtttgctgctggttttagacccgacagtattgtggttgatccccctcgaactggattagatgaccacctgttgcaagcgttagttgctcagcccccaaagaaaatggtttatatctcttgtaatgtttcaacattagcccgtgatttggtcaaattagcgtctgtcttcaagattgagtatttacagtctgttgacatgtttcctcaaactgctcgttgtgaagttgtcgttaaattgacgcgtatataaaaagcctagccatcttcaagtaaatgaagatggctaggcttttttaggaattcagctagtatccaaacacacattgttggacactagctggatcaaatcttattttgtgactaaagcatcaaggctggctactgccaaactcattttggcgatcttatccaataatgcaaaacgattgcgacgtattgcctcgtcatctaccatgaccattgtctgatcaaaataagcttcgattaatggtctcaatgaaactaggctttgatagttttgttccatcgtttgttgcgggaacttatcttcaatggcgaccactgcctcataaagcgtattttctgattcgttctcaaacaattcaggattgatttgtttgtgttcaagatctgccttttttgcaagattaatgacccttgtcaaagcttccatcgaaggtttgaaatcagaatcattcaaatgtgctctcaacatttgagcagcttcaaacaaaagactgatatcgccttgacgagagttgatcactgcttcgatcacatcatgacgaatgtttttcgttgctaagaattgacgcagacgtccgtcaacaaaatcaatgacttgctcttgtccttcgttcaattgaatgccatagactgatggctgttcattgattgctgtgcggattttttcctgtaaacgggctaacgggaagtaccaacgtttctcagcaataatccgaatgatgccataagtttgtcggcgcaatgcgtatggatcgttcgatccgcttggaatcatgcccactgcaaagaatgacagtaaactgtctaacttatcagcaattgctaaaattgctccaacgcttgattcaggtaacgcaccttcagcagagacaggcatataatgttcacggatcgcttgtgccacttgcggtgtttctccttgcaagagagcatacttttcacccatgactccttgtaattccggaaactcaccgaccatattcgttactaaatcaaacttatagatttctgatgcacgtttcaattctgttctttcatcttcagacaattcgacggtttctccaatgatttgagcaataacagctacccgttgcattttttcatataagctaccgattttttcgtggaaagtgacttgttttagtttctccacacattgatcgatggtaagtttcttatcctcattgtaaaagaattccgcgtcttctagacgcgctgtcaatactttctgatttcctttgactacattatcgatttttacccgatcgccgtttcttgctgaaatgaaatggggcaacaaaacaccttctggggtgcgcacatcaaaataccgctgatgttctttcatcgaagtgactaagacttcttctggaactgaaagatatttttcatcaaagtcaccgacaaaagcagtcggatattctaccaagttgttcacttcttctaaaagatcttcatcaagatcgatccgccagttgttttctttagcaattgcctcaatttggtctacgatcaattgctgtcttttggatggatcagcgatcacgaattggcgttccatttgactcaaatagtcatcggcagtttcaaaggtgacttcttctccaaggaaacgatggccacgggatttccgatctgttactacgtcaaggactgtaaatggtacgacttcagcgccaaacaatgctacgatccagtggattggccggatatactcaaaatcgaaatttgcccagtgcattgttactgggaacaccaaactagtaatgacctctttcaaaccagttaaaacttcaagcgctggtttaccttgaatatgcttggtgacatagacatactccacaccatttaattctttgaaggtaattgcatctgtggtcaatccttgtccacgaacgaacccttgggctgcttttgaccaattgccatcggcatcgattgcaatttttttggcaggtcctttcacttcttcttgcgtatcagcttgactttccggaatcccagtcacatatacagctaaacgtcgaggtgtagaataagcttcgatcgaactgaattgcagtgcatgagctgtcaaaaactccgccgttttttgttgtagctgtttcatgcttggcgtgacaacatgtgctggcatttcttctaaaccgatttctaataataggttttgtgccattttatttccctcccgcaatcaatttttccgcttcttctggtgctaataatggataacctagtttttcccgttcagcgacaaataacttggcaacttgtcgtgctaaattacggatacgagccaaatatccagcacgttcagttaccgaaacagctcctcgagcgtctaacaggttaaatgtatgactgcatttcaaaatatagtcatatgcaggatgaacgaggttttcatcgatacagcgttttgcctctgcctcaaagcggccaaaattgcttaacaataactcttgatcgctgacttcaaaggaatattttgaatgttcaaattcaggctgacggaaaatctcgccgtatttgacccctgtcgaccattccagatcatagacactttcaacttcttggatataagatgctaaacgttctagtccataggtgatctctgaagtaacgggtttgcaggccaatcctccaacttgttggaagtaagtaaactgagtgatctccatgccgtctagccaaacttcccaacccagaccagcacaacccatagaaggattttcccagttgtcttctacaaagcgaatatcatgttctagcggatcgatccctagcaaacgcagactttcaaggtataattcttgaatattttctggagagggcttcatcaccacttgaaattgatggtgctgatacaaacggttgggattttctccataacggccgtcagccggtcggcgagacggctccacataggcggcgttccaaggctccggtccaattgcacgtaaaaaagtatacggactcatggttcctgctcctttttcggtatcatacgcctgcattagcatacagccgttatcagaccagaacttctgtaaagtcaagatcatttcttgaacggttaatttactcattattttcttcctttcttacaacgcattgactactggataaaattcaacaacatgacctggaatcaattttacttcaacaacatggtcatccgtcaaaacatctgacaaatcatacaacatttggtccggttttgttgttaactctttgactagttggtcatcttgcttgactaagatttgcaatggaatacttgctaacacttttaattttttttctttgaattctgatgcagcaatcgtcatatcaaatggcatgagagtcccctccttttctaagtcattgattctaccgcaaaggttgagtttttcatgaaataggacacaggtactacgttctccctgcgagcctactgtttcacatctgctcgtctcttctgtgttactcctgcagtcacttctaccagcagggttcgctaacaaggacttgtatgtcctgttttacaggtcgatcacagtgattcgagcaatggtgaatcacaccaaaaaatccctatacctatacttgcgcatagatatagggacgatattctcgcggttccaccctacttccgattactcggcagcttcattgagtcatactcccggatgcctgcgaaaaaaggattcaacttggctttcactatcccaagctcgctggatgactctggcttctttcttttttccgatcaacgtatttatttgattatccttatcatagtagctgtatagggactttgtcaatcaaaaaatataaaagcaattaattagggcctaagtccggctgatcgtgaaagatgatcatatctgatacccgaccgtcactttcaaaaatcacagcctcgttgtttccttctcgtaaataaggagctggaatatataaccgtctttgcggtcctctctcccagaaacgaccaatattatgcccattgatcataataaatcctttgccccagcccggcagttctacaaatgtatctgcgcattcatccacttgaaagctcactttggagaaactcggttgtcccgtttgccagtgaccggaaaaatctacttgatcaagattatccatcggtagactgtatatttcccattcactttgaaacgcaccgttgacgatcactccgtctttgatacctttgtattgatgattcatttggacggagtaattgacccgtcccatgttctcaaccaagatccctaactcatttgactcctccgtcagtgtgagagtcttcttttgtccgatttcctgatcatattgaataaattgcagctgattattaataaacgtatgggctcgatcctgacaatggatcagtcgatagtcttcgatcacacgcgatttgccaatttgcgaacgataatagacatagccagtagcttgatctaacagttccatcgttaaaggataattgtgcttgactggttgactgatgctagctagtgtctcaaagagagaaactcgctgactaactttccagctaccataagcccgtttggtgatttttgtagtcaaaggaaaggatgggatttcggtaatttcacctatgacttgttgaaatgcttcatacttaggtgtcacatcgccccattccgataacaacgcatcatagtcatagctagtaacgtctggtgataatttctcataatagttggcaccattcataaagccgaagttcgtgccaccatggaacatataaatattgacggagccagcttctaagcagtcccgcaattcattagcagcgtcggttaccgatgtggtatggtgcttgtcatctccccatgcatcaaaccagcctatccaaaattccatgaccatcaatggctgcttcttcccatggaattcttgaagttttctaaaattctcctgaatgtctgatccacagttgatggttggcagtgcgatgtccttgatcgaaccgttctctaacatatccagccaaggaccatctgacgtaaataagggcacgtcaatgccattgtgacgcattagttcagcagactttcgcaaataacttttgtcatttccataactgccatattcattttcaacttgcatcatcaaaattggtccttcttgagtgatctgtaaatcactcacttgagaaaaaagctgtgtaaagtatcgagcgatcttttccataaacggtggatagtcaaagcgaatcttcatgaagggatcttttaacagccaataaggaaggcccccgaattcccattccgcacaaatataaggtgctggacgaaggatcacatacagccctacctcctgtgcaagctgaataaagcgccgcaaatcaagattatcgctaaagtcaaactttccttcctgcggttcatgcatattccaaggcacatacgtttcgactgtattacaacccatcaaacgtaatttttctaagcgatcccgccaatatgcaggcacaactcgaaaatagtgtatcgagccagaaataattttcatgggctgatcatttaaataaaattcgtctttgattacaaaagcagtcattcgcttcttccttccttgattacatatacactgtattgatctgcaacggagtcttcagtcaaatgcttaccggacagtaggtccttctttcctacaaattgtgccggcaccttttgcgcttgcttctgaaaattgatgataaaatagtaaaccgcttcttccgtatgacgacagctgatttctagatttgtttctccttcaatcacagcagttagatttgcgctattggttgcttcatccaagatcgtatctaaaagatctttttcaagttgagtcccaatataataaacgacaccttgaccaaatcgatttttggtcactgctggtgaaccggcatagaagttactcgtatagtccgctacagattcagcggtctccaaatggatgatctcactgactaagttactttctccctgtcttcccccctttaattgaataacgttcgtctgctctggtgctaatgcatcaatctcttctacccagattcctgctagctctcttaaaggcccagggtagccgcctagatggacattgtctgactggtcaacaatgccactcatatacgttgtgatcaaggtgcctccttgttccacaaaggattcaagagcttctttcatacctgcttttaccatgtacaaaaccggtgctaccagcacttggtacttgctgaaatctgcatcaactgacaccaaatcggttgcgatattcttttcataaaagtaacgataatattgatggatttgttgcacataagtcaaatcaactgttggtccgctcgtatattccaatgcccaataattatcccaatcaaatagaacaccaacttcagcctttgtttcactacccaaaacttcgttcagtcggctcaattcttctcctaatgctgcagtttctttaaatacacgggtgttctcatgcccaacatgttctatcaccgcaccatgaaacttctcacaagcaccaatggagcggcgaagttggaaaaactggattgtatctgctccatgagcgatcgtctgatagctttgcgcgcgcatttggccaggttttttcaatgaattatatggttgccagttttgttgggatggtgtttgttccatcaacataaatggcgcttgcttcaatccccgcatcaaatcatgagtcattgcaacgaaactccatggtgtattatacgaaggatagttgtcccaagaaacaatatccatttcttttgcccatttgaagtaatcgagtcctttaaaagttcccatcaaattcgtggtaatcggtgtttgactatcgaattgacgaatagcattccgttctaacttaaagttttctaaaagactgtcagaattgaaacgacgataatcgatagaaattcctgcaaatgcggttttgtcatgaccgattccttcagaaagagcattcggcagaacgatttcgtcccattcataaacagtatgcccccaaaattccagattccacgctttattcaatgcctcaagggtttgatacttatcttttagccagacccgaaaagctttctcacagttttcgcaataacactcacctccatattcattattgatatgccaacaagtgacttgcgggttaccaacatagcgttgtgccaatttcccagctaatcgttgtgcatatttttggtagactaagctgttaggacacgcattgtgccgctgtccaaatttatggtgcctcccttcatagtcagttcgagccacttctggatagcgcttgaacatccatgctggcaacgccgctgttgaagtcgctaatacaatgtcgtagccttcttcactcaacatatcaatcatctcatccaactcattaaagtaataatcgtgctctgaaggttggatttttgcccaagaaaagacattgatagttgcactattgatgtgtgcatttctaaaaattcgcatatcttcttgccagatttcttgcggccactgattagggttataatcgccaccgaataaaaaccgttcaaaaacttttttcatgtttgacgctcctttttctcattgataattattattgtaaggcttttcaaaaagttgtagtataataggattgtcatgattctataatatttcgaaacaaggagaattcaatgtctatctatttctatcagaacaaccctcggctccctgtcagtatcgagagcattgggaatcattgggcacaagatgaagtggttcgccccactggttatccatattatcactggttgcaaactaccgctggccaagggaccgtcctttttaacgatcaatcctttgtgttaactcctggggctggcattttgattttgccattcatccctcatcgttaccatcctcatagagactggcagacaaactttgttacgctgcaaggagatttagtacaggaactgttgaaaccttttggcggaaagcgctacttgatggggcaagatagccctttattttcttacagtgagtggatcaatcaacgaatcagcgacgatcaagaaaaaatattagacccattgcgctcttccagcagttgctatcactttcttttggcattgatccaacaacaaaatgctgacgcaaatgaaaagcatcatttgtaccaacgctacattgcgcctgtactactagaaatcgaaaccaattatgctcatccattgaccgtcgctgaacttgcggaaaaaatttttgtaactccgcagtatttgtcgcgtctctttcagcgctttttggggcagtcaaccttccaatttttgctgaattatcgcctgaatcgtgccaaagaattattggtaggcgagcctcatctggatatccaagatgtcgctttcttggtaggaatcccagatgcaagtcatttcactgctcttttcaaaaaaaaagttggcgctactccaaagaagtttcgccaactttatcgttgatctttgggtttcaggatatcttgccactgtcccatttgatcaataaattttttgcttttcaaatgtaagccaacatattcatcatacaataaatcaattacctgacgaatggcttgcttcgtttctggttttaacttgatcgatgcgatttgttcataagagatttgtgcaaacaaacgaataaaatggattgcccttggatcaccgtgataacgatggtcatctaatgcccaatgcttttcgcatatgacgccattgtatttcgaggagtaatcaaagcggccttctgtttgtccgcagaccgcacagtgggtccatatcggtgagaccccaaaacgctgcagcaactgaatctcaaaaatattagtgatgatctctgcatcattatcagtatccatcaactgcaaagcttcatgtaagaaatgatagagatttggatcgtacacgcggtcatcgatcgcagagtcagccagattcaatagatacgtagcatagcctgcaagaaaaatatcaccttggattttgcgaaaagaatggatatctttggcattattcaagaatgacaagccctcagaacgaatatttccaatataggtcgcttcagtgtacgaaagcaaagctggcgttaaaggattattcttgcggtgggcaccttttacatagaacatttgctttccagccgattcagtgaatattttgaccagtttatcattttctttatggtccctagtaaataacaagatcccttttgtttcaactaaattcatgaacaacgctcctttctaaaccagaaagctgaagcagctcaatccccttcgcttgctccagctttctttgtcttttctctcatcaaacttcttagctgatcttgtttagagaagatcagtaatcatcgttccgataaccgtagtctgtcaggaaggtttgtttgtctcgccagtctttttgaactttgacccataattccaagtaaactttatcgtctaacaaatgctcgatatctaatcgtgcttttgttccgatttgtttcagcattttgccgcctttcccaataatgattcctttttggctatcccgttcaacgacgatcgttgcttgaatatgaattttatcattttcatcccgtttcatcgagtcaaccaccacagcgactgagtgaggcacttcgtctctagtcagtaacagcactttttcccgcactaattccgaaacgatgaaatattctggatggtctgtgatttgatcctcaggaaaatattggggaccttccggcatttgatcaatgactaatctcatcaatgtctcaaaattatttccttccgttgccgaaatcggcacgatctccgcaaacgtcatttgagccgcataatcttcgataatagctaaaagttcgtctggatgtactttatcgattttattgatgactagaaagaccggcgtctcgtttttccgcagccgctcgataatgaagtcatcgcccttcccccgtttttgatcggcactgatcataaataaggtcacatcgacttcacgaagtgcactataagcagtttccaccatgaaatctcctaagcgatgttttggcttatggattccaggtgtatcgataaaaacgatttgtgcatctggtgttgtgtaaaccccttggattttatttcgggtcgtttgtgctttgtcgctcatgatagcgattttttgacctactactcgattaagtaatgtggatttaccaacgttgggccggccaacaatggcagcaaagcctgatttatgtgttgtcataggtgatctcctctgtgtattatctttctaaaagaacgctaaaatttttggtataaaaataattgccgcaacgatcaatgcaaagaatgctgtcatcaggactgctcctgccgccatgtctttgatttttttgccaatgggatggaagtgaaaatcggtaaacatatcaacgacattttcaaagactgtgttgacgatttccacgatccaaaccaaaaataccgacaacaacaaccagagccattccatttgatttaatctaaagacaaatcccgcaatgattgcaacgatgcctaacaagacatgtttgcgcatattgcgctcttcgtcaaagacggtcttgattcctgtaaaggcaaattcaatggatgtgataaattgtttgtttttttctgtattcttatcttttgagtccataggcatccaatatttccttttgcagaccgaacatttctttctcatcttctggtgtcatatgatcataaccattgatatgcaaaaatccatgcagcgctaaaaagcccaattcccgatcatagctgtgtccatactcactagcttgctcttttgcccgctcgactgaaatcatgatatccccaagatttctcggcatagctggcatttcatcatcaaagatgatcggcaactcttcttccgtttcttcttccaaagcaaaactgatgacatccgtcggttgatctttatcacgatagtcccgattgatgacttggatagcggcattgtccatgaaggtgacagacatttccgtatcctcaggcagcttcaaatagtctgccgcatactgcagcagttcatcaatttcattgattttctcttgactcactgtatttgtttcatctaaaaaagcaatctccattaccgatctcttctttcttgttcttctttcattttttccgcttcggacttcattttcggatatttgatccgtgaatggaatgtactacacaatccattgactaaggacttttcaatgatacgaatttcatgcaatgtcagtccggactcatctaattgtccatcaagaatccgatcattgatcaaattcgaaacaaattccttgattttctgatctgtgggattatccattgcccgcacagcagcttcacaactatccgcgatactaacgacccctgcttctcttgtttgtggttttggtccaggatagcgaaaatcggcttctgtcacttctggattacgttctttcgctttgacatagaaataacgcatcaaggttgttccatggtgctggcgacaaatatccaccaccatctgaggcattttctcattttctaaaagaaccgctccatcgatcacatgtccgaaaatgatctgcttgctgtcttccggaagcaaaaagttatggggattttcagcccctgcgggtaaattctcaacaaagaaattcgcatgctttaatttaccaatatcatgatagtaacaagcgacccgtgtcagtaaactttgtccgccgatctctgctacagcattagcactcaaattggcgaccatcatactatgatgataggttcctggtgcttcttccagtaattgtttaagtaacgggtgatttggattacttagttcgttcagaacgatcatgctattgtctgagaccaataactcaatgtattgatgcaaaccaatcgttagtagatagctaagtaatgaacccgctaaggcacaaatgatcgtcgtccaggtattgcctctcgcgaaatccatcccttggaaaatcactaacatgacacttaataagaacggaaagacgatgacccacataatggctgttcgtccttgactggcgattcgttcccttctgatcatcgttcccatcaatccagagaacaaataggttaccaagacagtagtcagcatattcgtaccgctggaatcaaaataaatgaaaatcgcattgattacttgaaacatcgcagctaaaattcccaaacgccgacttgagaatatattcaagatcagcggggtaaaggcagctggaaagaataacggaatgaacgcgatgagttcagactgaaatagttggaaaaacttcatcaataaaatactaaaaatcatcgcaatgacataaaaggtcacagcattcatccgtttgtcttcgttttttgtctgccgtgtgtaataaaagagcatgagcatctgtaaagcagcagtaaaaactaaagcaatcaacggaaatacagagaaggtttgactcgtcagaccgagaagctgcaatttttctaatgcatttgaatcaatctgcgagccttcccggacaatgatctcaccttgatagatcataacaggctgaacagcgtctttggcagcctgccgagcttcttccgttcgtttctcattaggaaaatcgttgacaacgatcccttgattgactaaaaagcgtaatgctgttgccatttcagaagttacatccaaaaactggatcttttcttcggcttctgatcgaaaagtactcaattcagattggcggatctgtttagccatttgttcatcaacaagctgcagcgcataatctcttaccgtgttcagctgatcactattcaatgaaaacaatgtcgacaaaaaattattggtcagcgcttgataaaaatcaagttcatcatcactcattttttcaaattctttttttaaagtggcgatatactcttctgtatccggtttaggaacattttcattttcaccagcagctttgaccgcagcttcatatttcgtattgacagtcttgttgactgtatcaatcaattcaaacaaatgattgatccgttcatgttgaacttgtgccaaatcgtcttgatacgtgtattcaggcgagacggcttcagcggctagcgtacgtttttgttcagtagcagttgtgttttcaatcgttttgttggctcggatattttcttccgcaacctgcccctcgctatagtcgacattgttttgttttacactggaaaacatgatcccaatagataaaacaaaaaagagcaccataagcagcggcaggtaaaagcggcctaatttttctcgaaaattccgtaacggttgtatgatcattttacccctcctgtccgacaatcaacgttgttctttactatcggattcctcataggcacgtataatgtctgcaacgactggatgacgaacgacatctcctgcttcaaagtgcgcaaacgcaattttaggaattgcttctaacgctcgttgcgcatgaatcagtccgctcgttgttccttttggtaaatcaatttgacttgtatcgccattaacgatcatttttgaattaaatcctaggcgggtcaaaaacattttcatttgggcaatagtggtattctgtgcctcatcaagaatcacaaaagcatcttccaaagtccgccccctcatataggctagcggagcaatctcgatcacgccgcgttccatcaaacgattggtatgatccataccaaagatttgataaagggcatcataaacgggacgcaaatagggatcgactttttctttcagatcacctggtaaaaagccaagattttcacctgcttcaacagcgggtcgcgtcaagatgattttttgaacttgtcctttcttcaatgccgcaatggccatgacaacggcaagaaacgtctttccggttcctgctggtccaacgccaaaaacgacatcatgggttctgatggcttcaatatatttcttttgtccggcattttttgcgcggatcggcttaccgttacgatctttgatgatttcttcttcatacatatctgtgaaataatctaagtttcctttatttgccatgttcaatgccgtaataacatctggcgtactgatattgatccctcgtttgatcaactcttgcaacgcatggatcacggattgggctttttcagcggctgtcttttcaccaatgatttggatcatttctccgcgggtatgaatcgttgtttgtgtagcatcttcgatgactttgatatgtttgtcatgggaacccaacaacaaactaatatcatcattttgagtcagttggatttccaaagaaatacgctcttctgtcaaataagttacagctccttttttaggcattctagtttataataccacacaatcgctaaaagcaaaattacttgtaagcttcaagaagcgttttggcagcgttctttgcaatttattaaaagtttgtttttcgatcattgattctacttaaaaatactcactaagaaagaacaaaaaagccgtaagcatccaataagatgcttacggcgtgtccttacatttgccctaataattctttgacgatcgcattgacttggttgccgtctgctttgccttttacttgaggcatcacagcgcccatcacttttccgaattccttcggagaagaagctcctgttttttcgatcgcaccagcaacgatttggcgaatttccgcttcatcaagttgtgccggcaagtatttttcaacaattgcaatttcacctttgactttttcagccagatcggtacggtcggctttctcaaattcagtcagagaatcacgacgttgtttcatttcacgagacaacacagtcaattcttcctcttcgttcaagtcggcaccttttttgatctgttcgttttgaatcgatgctttcaacatgcgaatcacctgcaacgtttccttgtctttggctttcatcgctgttttcatgtcatcattcagtgtacttagtagcgtcacactaccagctccaattctcaaaacagtagaaaattagaattttttacgttttctagctgcttcagattttttcttacgctttacacttggtttttcgtaaaattcacgtttacgagattcctgtaaagtacccgcttttgacacggaacgtttgaagcgacgaagagcatcgtcaagtgattcgtttttgcgaacgactgtttttgacatgtaaattccctccctccgagcttaaaaagtaaccgtatttgtcattgaaataaaatctcaaaaaacaagactgtcctttgaaaattatagctaacccctgaaaaagtgtcaaggtattctagtaaaaaagtcgatgaacttcctgattcaatcttagaatccgaacaatcagcgacaatcttcacatctgcctagaatttcaaaacgatggccttcgatactgcacccgggcaattgttcttgaaagaaatccattggacaaatatgcagctcttttgttttgccacaaaccgtgcaaataaaatgatgatggtgatgatcttccaattccacgcagcaattataacgaaatttcatttctccattcaattcagtctcttccaagatgccaatctcagaaaaatcatgaaggttccgatagatcgtgtcataacttagacccgggtattcttcagacatgaaatcatggatttcttttgccggcaaataacggttgcgtttcactaaataagtaatgatagcttctctttttttggtatatttatagccatgttcttttaatatcgacatagcttgctcaatcaatggttgatttttcatcgaatccctccagtaaatcaaaatcattccgatttttagcgatcgtaagtatggtataatgaaattatcaaaaatgcaagagaggattttactatgaacccacaagaaacgattgtcacgatttttgtcttgtccgattcagcaggagaaacggcctccaaattagctcaagcaaccatggcacagtacccaagtgttgaattcaacttatttcggcgtacctttattcacaccaaagaacacttgatccaggcgttgactgatgccaaaaaacacgatgccattattttgcacacactgattaacgatgagctagtctcgctaaccaatcacttttgtgaagaagccgacctgtatcattttgatgtattgactcctcctgtcaccgaggtagaaaaacgcacaggtgtcgctccgtcgcgagaacccggcgcattgcatcatttaaacaaaaattatttcaaacgtatcaaagcaatggaattcgctgttaaatacgatgatggaaaagacccacgaggttttctcgaagccgatgtcgttttgttaggtgtttcccgaacatcaaaaacaccgctaagtcttttcttagccaacaaaaacttgaaggtggcgaatttgcctcttgtgccccaagcacatattcctaagcagttgtgggaaatcgaaccgagcaaaatcgttgggttaacgaatgatcccgacgttttaaacagcatacgcaaagaacggatgcgttcttacggattgaatccagacacggcgtattcagatattgaaaaaatccgggctgaattagagtttgccaatgatctttatcaaaaattaggctgcatcgtcattaatgttgcctctctttcaattgaagagacagcttccatgattttgaatgcattgaatttggaagaccatagttactacacgtcagaaacagaagaataaccagccacatacattttagacaaaaagatccccagagtaatggtcagctagactgtaccattattctggggatttttgcttgtgtcaaatcagaaaagtctaaaagacttggacgccttcgcgatcgatctgcagctgttcgattgctgcattggtttcaagcgcatggagaaggcggcagatcttatctgccttttcgggtgggacaatcgctaagacagttggtccagccccactcaggaagcagccatagccgccttcttcttcacaaatttggcggatcgtggataaatgcggaattaatttttcacgatagttctcatgaaaacgatccgcctgcatcattttacctgctaaaggtagattccctttgatcactgctgcgatcatcacattggcgattgcactggcttcaacagcagttgaaaagtccagtgttttagggaggacattccgactagcttctgtcaacaattgttcttgcggaatataagcaacaatattgcattccggaaaatgatgtttaacaacataagtttgtttatgttcatgatcaaaggccgtaatcagaaaatcgccataaattgccggtgccacattgtcggggtggccttcaatggccgttgcaatatcaactttctgtgcatcacttaagttcaggtgtcctaaacgattggctaattcgattccagccacgataaccgatgaactgctgcctaatccccgtgctaaaggtatatctgagtacatgcggattttacgcggtgtaagtgtaggtgcaagcttcagcgcgacacgtaacagcagattactttcatcattagggatttcactgccgagttcatgtaagatctcccatcggtcactttcttccataatttcaatgaatagatattttgagagagcaatcccgcaagaatcaaaaccaggtcctaaatttgcactggttgcaggaacgcgaatcttcatagttgagacactcctttacgcaggtgttgccgcatttcttctagatcactcatcttatggatcgctacttcggtagcctgaatagctgtatcaggatctttcaagccgtttccagtaaagactgccactacggtttcaccaggacgaattttcccgtttttcacgtgctgaatcacgcctgctagtgaagcagccgatcctggttcaataaagacaccgtcttgtgcagctacctttcggtaagcattcaagatctcttcgtcggttacagcatcgataaacccttttgattcatcacgagcggcttctgctagcttccaacttgctggattgccgatccgaatcgctgttgcgattgtttctggctcttcgattaccgcgccttttacgattgctgcggcaccttctgcctcaaatccatgcattcttggtagtgaagtcccttgtttgtcatgccattctttgaatcctttccaataagcagagatgtttccagcatttcctactggaattgctagtacatctggcgctttctccaactgctggcaaatttcgaaggcagcggttttttgtccttccaaacgataaggattgactgaattcacgagggccacagcttctgttttggcaatttctctaactgcttttagtgcttcatcgaaattcccgggaatagaaataatatccgcgccataaacgattgcctgtgccaacttgcccattgcgatcttaccatctggaatcaccacataggctttgattcctgctcgtgtcgcatacgctgctgctgcagcactggtattaccagtagaagcacaaacgattgcttttgcgccttcttccaccgctttggctactgccatcaccattccccgatctttgaaagatccagtaggatttagtccttcgtatttcccatataatgtgatacccaattcttttgataagttattcaatggaatcagcggtgtgtttccttctgctaatgagattagcggtgttttttctgtcaccggtaaatactctttatagtgctttaatagtccttcatacatctgctactcctccattactttcatgatttggctaattcgaccatcttcaaaaatcgataatgctgctgttaattccgagggactcaatggcttcgtcaaaaatgctttcttttccaagatagattcttggtcgatccagtccaatgtctgttgctgcgctgctaatggtccagtcaacgcaatgtaataacgttgacgaagctcatctggtactgcaatctgagtcggctgttcaaaggttagaaatgattcagtgatcccagcagatttatttttagcgatctccgtcacatctgccagcacactcgtcgcagtaggacgagcccccgctccaggcccgtaaagcatggaacgatcgatgcccgtactttcgatatacacgccattaaactcatatttgattgaggctagcggatggggcttagggacaagaactggaccaacagaaacagcgacatgattttttggtgtcttttgtgccgtaccaataagtttcacttcataccctagttgttgggcataaatgatgtcttcaattgctaatccacgaatgccgccgatagaaacatctttcatctcgatcgtcataccaaatgcaaattttgtcaagaggaccatcttataagctgcatcaataccgtccacatcattggtcgggtccgattctgcaaatccttttgcctgtgcttcagctagaacttcctcataacttaagttatctgttaacatttttgtcagcatataattcgtcgtaccattgacgatgccagaaatcgaggtaatcgtatcgggtaaataatgcgtgcttaatgttcgcaagataggaatcccgcctcccacgctggcttcataatacaatgcaacaccggcttttttagcagcggcagtcagttctgggccatgagacgccaagagatctttattggcggttacaacatgtttcttgtgagctaacgcaccaagaataaaatccttcgcaggatcgatcttgccaatcaattccacaatgacatcgatggactcatcctgatagatttcctgaatatcactagtcagttcaaacccgtatttttgggcaattgcgcttttatcatcataaggagaggccaatgctttcgtaataaaaatctcgacaccagttcgggctgcgattgcctctctttgttccgctaatagttggcagactccagtgcctacgacacccattcctagtagtcctatatttaattgctctttcatatagcctccttaccgaaaacgttattaaaaaatcgttcatccatttttaattttctactagcataccaaaaagcataagaaaaaactagggctttcgagaaattctcgtcctagtttcagcggtgatggatatgagcgaatgttttttgtaagatgtcgactacgtgcttgtcatctaaactatataaaattgtctttccttgtcgttccgattttacgatccgattatctttcaatagtttcaattgatgagagaccgcagattgttccatcatcacttgctctgcgatcgaagttacattacgttctccttcttctaaagaaagcaatatcttcaaacgtgtaggatcaccaagcattttaaaaatttgagtgactttttggatatcttcttgatctggttgagtcatgctggtcttcctttcttgatggtgaataaaattctagctggttcaagcattctttgtcaagccccattgaaaacaaggcgtcaaaataaatgcaggatccacccaaatacctggaaaagaagcagcacattttcctataataagttctccaagaagaactgaatatcagcaaaataatctatctgattctcatccaagtatttgaaaaggatctagctcttgtttatcgcttaaacttctgtaatttcattaatggcagcttcaagttcagcaattttatttgctgcatcttcagaagagtttcctttgacaccaatgtaaaatttgatttttggttcagttccagaaggacgaaccgcaatccagctctcatcttcaagagtatatttcaatacatctgacggtggtgtagtcattttttgcatgtgaccatctaaaccaactcttgtcaattctttgaaatcttctgtttgaacgactggtatacccacgaaaactgatggtgctttttctcggaatgttttcatcaatgcagtgattttggctgcaccttccataccgctcatcgtaacagaaatcgttttttcggcataataaccatattcctcaaagatatcttgcaatccatcataaagtgttttgtccgattgtttataaaaagcagcgacttcagccaacaagacaagtgcttggatcgcatctttatctctcacaaaaggttttaccaagtaaccgtaactttcttcaaaaccaaacatgaacgtatgggaatgatctgtttcatactgttggattttttcggcaatgaatttgaagccagtcaatacattgaccatttcaacgtcgtaagactgggcaatcgctgttggcaattcactagaaacgatcgattttaggactgctgcattttccggtagtgtgccggcattcttgtgggcttctagaatgtaacggatcatcaatgcgcctaattgatttcctgtcaatacttgatagtttccatcaggcatccggactgcagcacccaagcgatccgcatccggatcagttgcaatcaacaagtctgcgtcttctttttctcccagagcaatcgcatattcaaaggcagaatgttcttctggatttggtgacttgactgtactgaagtttggatccgcaacagcttgtgaaggttcaataataaattgctcaaaccctgcttgtttcaaagctttttcaccaagcatccgacctgttccgtgtaatggtgtgtaaactaatttaagatttttccctgttgtctcgattaatttttgatcgattgtcactgttttgacttcttttagatacgcagtatcgacctcttcgccgataatcgtgatcaatccactatgctttgcttcttcttctgataaaactggaatttctaatggattttcaatttctcgaacaaaagctgtcaaggcgtccgcatctgctggaggcatttgtccaccatcttcgccgtatactttgtatccattataagctgccggattgtgagatgctgtaatcatgattccagtgaacgtatgcagataacgtaccgcaaaagataattcaggggttggacgtaagctttcaaacacaaaggcaggaatatcgtgttttgctaatgtcttggctgcttccatcgcaaattctggtgaaaaatgacgagaatcatatgcgattgcgacaccgcggcgacgggtttctggatcttgtgtatccatgaagcgcgccaatccctctgttgcttgacggaccgtatagatattcatgcggttgatcccaggtcctaagatccctcgcatcccagcagtaccaaattcaagcggcatataaaaagcatcttgcaacatttctggatctttctccagttctgttaactgatccttcaaccctgcttctaattgttgatgatttttccattgctcataaatttgttcccatcccatacaaaaaccactccttctaactttaaaatgactataattttagtataacactacttctgtttttctcaaagaataaccaaacgaaaatgcaaacgcactgctatcaaaaacgaataacgttttataaataacagtgcgttcgataattatttaactggttgctggtctttttgtgtttctataaaatcaaatacttgttggccagcgatactgccgtccccgactgctgtagtgatttgtcgtaagcctttttctcgaacatcccctaccgcatagacgcctggcatagttgtttccatcatttcattggttgggatccaacctgtttcattcgtgagtccactagctctgaatggttcagtcaatggatctagcccaacgtagataaagacaccaccagccgcttcttccgttacttcatttgttttgacatttcgcacttgaacaccagttacgaccatctcgttgcctttgatttcttccacgacagaatcccaaataaatgagatcttttcattggcaaatgctcgttcttggatgatcttttgcgcacgtagctcatcccgacggtggacaatcgttacttctgaagcaaattgtgttaagtagatcgcttcttcgactgcagaatctccaccaccaactacgatcaaccgtttgttgcggaaaaaggcgccatcacaaactgcacaatatgaaactccgcgtccagcgaattcttcctcgcctttgactcctaattttctatgtacacagcctgttgcaatgatcacagttttcccttgataattcttgtcttctgtgcagacttccttgtactctccatgatccgtgatcccttgaacgatgccataggcattctccacgccaaagcggatggcactttcatacattttaaaagcaagttctgggcctaagatcgaatcgaagccaggataattttcaacctcagcagtattattcatttgaccgccaggagctccccgctcaatcatcagaacagataaatttgaccgtgacgcatacagcgctgctgtcatgccggcaggtccagcgccgataataattacatcatacataattgttccctccattttcgactacccatactttactttcaaaaagaatttctgtcgaatgttctgcttacaaaaaataataagatattcccgtttttttctctgaaaattacattgactttcttttcattttttgtaaaattttcacgatacatctattatatagaaaacggggagtccttacaattgaataagaaaaaacttttgaaaagatctgatcgggaactattgtttcttagctggccgatttttgttgaactatttttacgtgtgattattgggaatgtcaatgtatggatgatttcccattattctgaaccagcagtcgctgccgtcagcgcagcaaatcaattgctgaatctgaccgtctttatttatggtttcatcactgttggtacgcaaatcattattgctcaactaattggtgcgaagcagcgagataaaatccctactgtgatcaatacagcactttttggttctctattcttaggtattttgatcagcttgatgtttatctttggctctgatcaattgctgcattttatgggattagaagaagcattggttgatttgggtcgcggctacctgcaagtatatggcggaagcttgtttatttcttcgctgacagctgtcattatcgcggtcatgcgtagccacagctttacgaaacctgctttgcttgtaccgatgtttgccagtatcttagctgttattggtaactactttgtactttacagtccttttggcttacctaatttcggtgtaacaggactagctttctccagtgtcttcggcaatacgattggcttgattgttgcggcatttttactgaaaaaacacgttggtttttctgttctttctgcccgattgaagtatttatcatgggatgtaatgaaaaatgtcttaacctatggcctaccttcctcaggagaatctttgtcttatcaaggagcacaagtggtagtaacgatgatcgttgcgcaattaggttcaagcgtgctgattgctaagtcttatgttacagcgatcactcaatttgtgtatttgatcgcctcggcgttaagtcagggaaatcaaatcatgattggtcgtcatgtaggcgcaggagaatttgagcgagcacaaaaacggggcatgcgcacaatgatcattggcatcatcgcttctgttacaatttgtttattgacttatctctttatcgaaccgattatgggaatctttactaccaatactgaagtcatctcaatcgctaaaggcgtatttctcgttgaaatcgtcctagagacagcacgtgcggtcaatatgattctagtgggctctttaaatgccagcggggatgttaaattcccattattctgcagtttgatcgttctttgggtcatcagcttaccattctcgtactctttggccatcgtctttaaatttggcttgattggtgtctggatcgcttacgcaattgatgaagcattgcggagtattttaatgatttatcgttggtattccggtgtgtggaaaaccaaatcggtagtccatggaaaagaaattgaaggcgaagtcgcttcagaaatctaatgacttgctaaaaaggtcatcttttctgccaattagacaatcgaatgtcaaagcgaataaaagagcgtgaaacaaaagtaaaaaatacttttgtttcacgctctaaacacgtctaaacagcggtagccgaaacaatgtcttcggaaataagtcgaaataccaaaaaattgaaaagcaatttccatatattcctccttatttatcgaagtttaacacttctgatcccaacctttttttgctgccttgtgtctatttactgctgaaagaaaatcaattatttttggtttttcctccagattgaaatatactaattacaagtttagaactactgaacaatcaacaattagaaaatactgtcaactatcgaaaggagcaaaaaaatgtcaatttacgcgtttcaagccactttggaaaacggtgaaacctattcattagaacgctatcgggggcaagccatcattgtcgtcaacacggcgacaaaatgcggattgagcccccaattcaacgaacttgaagaattgttccaacgatatcgcgaccaaggattgatggtcttaggcttcccttccaaccaattcaaacaagaagttcattctgctagtgaagctgccgaagcttgtcgcacaacctatggtgttgactttccgatgcatcaattgacagtcatcaacggaaaagaagctgatccgctttttcaatacttggaggaagaagccccaggaacgatggggaaagcgatcaaatggaattttactaaatttttaattgatcgcaagggacatgtcgttgaacgttttgcccctcagaccaatccaaccaaaatgatccctagtattgaaaaggttcttggctaatgatctaaccagaaaaaacatccactcactcatcggtttgcaacagcaatgaatactctctcactgctgtttgcgccatgaatgcggggatgttttcttattctttaaagttgttctccatttgaagcaatcacttctttgtaccaatcaaatgattttttctttttccgggccaatgttccgttcccgtgatcatccatgtccacataaataaagccatagcgttttttcatctcaccagttcctgccgatacaagatcgatacatccccaaggtgtatagccaatcaagtctacgccatcaagagttatcgcatctttcatggctgcaatgtgttttttgaaataatcaattcgataatcgtcattgatcgagccgtcagattccactttgtctatggcaccgaatccattctctactacaaataaaggaagatgataacaatcagacaattgacacaatgagatccgcaaccctaatggatcgaccgcccagccccaatccgattcggctaaataaggatttttcaccgcaggcatttggttgccgccaacatacttgactgtttcaggatttgctgaagaagcggttgacatataatagctaaaaccgatatagtcaaccgttccgttcgcaatgaccgcgtcatctccagcttcttttttgatttcgatcccttcacgttcgaactcttttaccttgtgggcaggataatagccttttgcttgaacgtcaatatagaattcttgttcccgattgaattgcaatgcagctaaaacatcctctggattagctgtcatcggataacttggaatatacgccaccatcatcccaatcatgaaatccgggttgattcggtgtcccatttgtactgctttagcacttgctacaaacaagtgatgagcagcttgatacttatgctgcttatcatttttatgaataccaatttgtgtccaacttctcaaaaagttgatctcgttaaacgtcatccaatatttcactttatcttggtaacgagtgaagatcgtttcgcagaaaaacaagaaatagtcgatcactttgcgattcgaccaaccatcatattcatccgctaaacacataggaatatcaaagtgattgatcgtcaccactggctcaatgccatgcttcaacagctcatcgaaaactgcatcataaaaagccaggccgtcttcgttgatctctctggttccttttggacaaatccgcgcccaggaaatagacatccgaaaacacttaaagcccatctctgcaaacaacgcaatatcttcctgataatgatggtaaaagtctgtcgccacatgactaggataatactgctctggatcgatgtacccaacggcaccttcaggtaattcggtatcccgagtaactttcccgatctggccgtcttttgttttataggtaatcattcgcggctgatccatactgcctcctgtaatggcatcgagggtgcttaacccttttccgccagaaagatagccgccttcatattggttcgcagctgttgcgccaccccaaagaaaattttttggaaaccccatattatccctccatcgtaaagactatcagcggctttcttcttagaattcatccaagaagaagccgcaagcatgattatttgtttgttaagtcttcgccatttgaagcaatgacttgtttgtaccagtcgaaggattttttctttgtccgtttcagcgtaccattgccttcattgtcgcgatcaacatagataaaaccgtagcgttttttcatctcacctgttcccgcagagaccaaatcgatacatccccatgttgtataccctaatagatcaacaccatcttgttcaacggcgtctttcatggcttgtatatgtgctgcaagataatcaattcggtaatcatcctccacatagccatcagcatctggtgtatcaacagcacccaaaccgttctctacaatgaataatggtttttggtaacgatcataaaggtcattcatagtaatccgcaaacctaatgggtcgatctgccagccccattcgcttgcttccaaataaggattttttactgaagcaaaaatatttccagaagtttgttccaatagctcagcatctgttgtcgatacccgagaagagtagtaagagaatgaaataaaatcaactgtgtgggccttcaataactctaagtcgccttcttccattttgatctcaatcccgttacgggccatttccttcaatgcatattgtgggtattctccccgagactggacatcaatgaagaaatagttttcgcgatctgattttcttgatgcccaaacatcttcaggcttacttgtgtaagggtagtaggcacctgcagccagcatacagcccactttattttccggatctacttcgtgagcgattttcgtcgcaatcgcagatgccaataattcatgatgggccgcttggtatttgacctgctccacgttgtcgccttcttcaaaatagaggccagctcccataaatggcgcgtgaagaatcatgttgatttcgttgaaagttaaccaatatttgaccaatcctttgtaacgattaaaaataactcggcataaattctcataaaagcctactaattctcgtgaacgccaagcaccatatttttctactaaatgcattggacaatcaaagtgcgtgatcgttaccagtggttcaataccatatttatggcactcattgaagagatcctcatagaatttcaagccgtcttcatttggtttttgttcgtccccttttggaaaaatacgactccaagcaatggacaaacgataggttttaaagcccatttctccaaataaagcaatatcttctttgtaacgatgatacatatcgattgcttctttggcaggataaaaatgatcctcatcaaaatcaaacattttcatctgtcctgtgatgactggaaaacgatctttaccgatcggtacaacatcgacattggctaagcctcgcccaccttcgttgtaacctccttcacactgattggcagcagttgcgccgccccataaaaagtcttttctaaatcccattatttcattcctactttcttgatattttgttgattaattaagtgattttgccagttcgtcttgaacttcgattccttctttttccaaacgctcaatcgttgatttaaagtttggtagataagctttgtgagcaataaataattcatccattacgcgtttagctgtttctcctgatggcaccaatgggttaatggtgaaagcttgtaatgcggtattgtaatcgccagtaaccgctgcttcgatcgttaaaagctccatagccttcattacttgtagccagcctttttctgcagtcggcagctcgccaaaagccacattgcgggcaccttgtcccccaacatacgcggtaacttcgacaacacaatcagccggtaggtcaggaacagctccctcatttttggttgagaccacgatctgggtatttttgtttgcataaatcgaggcaatcgtttcgcaagccgcatctgaatagtaggctcccccacgttgctgcagctgttctggtttatgatccaattctggatctttataaagttcaaaaagttctgcctctgtttgcttcacttgctgcgctctcgttcctacagtctgatattcttccagtgcatgcttcaacatttcttcttgacgatagtaatagcgatgataaccgcaaggaatcattctcatttgttctaattgttcacgataaaacggcacatcaaaaatatttttcggcaaaccattatcttcctgatacattttatcaataatatccatcgtcacatcatttccgtgtgagtcagtgactttatgccaatggaaatggtttaagccagcaaatttgtagattaactcatccggctctttaccgatcaatgcaggttcgatcatggtcgccatcacaggaacattgcaaagtccaatcactctatcccatttcccataacggacaaccgcttctgtgaccatgccgcttggattggcaaaattaatcaaccaagcatttggacataagcgtttcatatcttctacgatttccagaataattggtactgtccgaaatgctttaaacatcccgccaggaccgttggtttcttgaccgatcatgccataataggcaggaatacgctcatctttgatccgggcattcagcaagcctactcgaaattgagtcgtaacaaaatctgcatctttcaaggcttcttctcgatccagcgtcatgtggattttcacatcataaggagaagcatcccacattcgctgtgccatcgctccaacgattgccagtttttcttttcctgcttcgatatctactaaccaaatttcccgaattggcagttcttcatagcgtttgataaagccttccattaactccggagtataactactgccgccaccaatggtagcgattttgattccttttgtcattgtattgctcctttgctattttatttacacccttattatcatttataaaataattcgattcaatgtaaatttattatttagaaaaagcgtttgcaaatctagggatatcttgcgagtgatttgtaaaaagcatttacaaatcgaatgatataaggaataatatttatatcgacaattattcaaatactcaaaaaagaaaaatttccgataattttatttacaaacaactatataaaaatgtaaaaaggaatgtggataccatgttattacaagaaaaaatgcgccaaatcaagttggcccctgctgaacgatctttgatcgattttttattagccaatccaactgcgatggctgatcaaaccatcaaggaattgtctgaaaaaacctacgttcatccttctacttttattcggatcgccaaaaaattaggcttcaacggttggctcgacttaaagacagcctttttggaagagcaaacctatatgagcagtcattttacagatgttgatgccaactttcccttttcctcccatgacggcattatgacgatcgccaaaaagttagcgaaactcgaacaaacaacaattgaagatacgctttccttgatccatcacgatgaactgcaaaaagcgaaacaatcgctactcaatgccagccatatcaagattttcgcaagtaatgccaataccttgatttctcaagactttgttttgaagatgcggcgtttaggaaaaaacatccatgtttgtgacacttttggcgaaagtgcttatgaagcatccaactgtacttctgatacgacagccatcttgatttcttatactggtgaaaacaagatgatcaaagaaatcggtaaaattcttgccgaacgtcaagtttcaattattggaatgactagtattggcgagaacgcattggcaaaattaagtgattgtgtcttaaatatcacaacccgagaaaggctttactcaaagatcgcaaatttcacaattaatacgtccgtttgctacctactggatgtgctgtatggaatcgtcttttcggaacattatgaaaaaaatcttcagcatttgatcgatattggcatggcttatgacaaacgtcctacttcctcaacgattatcgctgaaccaacctacgataaaaatcttcaatacaaagactctctgtttccgaattaaacggctgacaaaaagcgatcgccccacatggccgatcgcttttatgcatatatagctctttttagaaagtttttgctaaacgagagctgtaatcaaatcatctgaacaagcaacttcatttttatctgattcaataatatctaagtaatcagcagaatttgttaccaaaacaggggtctcaatgttgaaaccagctttgatcagcgcatctttgtcaaaggtaatcaatttttgacctcgagttactctatctccttgcttgacatgcgcttcgaagtattgcccattgagttgaacggtatctaaaccgatatggatcaacaattccaatccgttatctgagatcaacccgatggcgtgtttcgttgggaacaatgtcataacggtaccatcaaatggagcaacgacttccccttttgtaggatggatcaagattcctttacctaagatcccttgggcaaaagcttcatctttggcactgcttaaaggtgcaaccgttccttcgataggagaactaatgatttctttacgtacagacattgtaggttcgccttcagcaatttcttcgactactgtattgtctttccagaatgccatcgtcaaaccaaaaccaatcgctgcagagatggcgatagcaatcagtgaagtccacatgccactcgcatctccatccggtgtgatgaagttaaagatcccgaaaataccaagtccgcccatcgtgtagcccgttacaccattgaccattaagaacagtccaccgacagcaccaccgatcatagaatatatgaaaggagtctttttaggaagagtgatcccataaatagctggttcagttacaccaaagataccagaaatgatcgctggcggacataatgctttcatctttttgtctcttaatttgaaatacatggcaacgacaactgctgtttgagcaaagctagctccgaaggaacctgtcaacacttggctgaatccttgttgcgtaacttgcatgatcgctagtggcacaaccgaccagtgtaagccgaagataaccaatacttgccagaagaatcctagaatcaatccataaaccgctggcgagaagtccattagcgcttggaatccggcactcaagagatctgtcaacatgctgatgattggaccaatgatcaagaacccaacaggtaaagcaatcagtaagacgaaaaatggtaccaagaaagtttgcacgacacttggaatcacttttttagcaagtttttgaatctgtgcagcaaatgcaataatgaaaatgactggtacgacactacttgtataggttgcccctacccatggaatacctaagaaagtttgataggcagattgtccaagtaagctataaggtgctgctgctccttctccggcaactgcggtaaaggctgtttgcagcgcagtgccttgaatcgttgggtagcatagagcggctccaataacgataccgaccatcggattcaaacggaatttttttgcagaagtataacctaaaataaccggcataaacataaatattgcatcaccgatcgcattcaacattacatatgtgcctgattctgctgtatagttgaaccaaccctgtgtacccaaaaagactaataatgcattaaaccctttgatcataccggcagctgctaacgcacctaagaaaggctggaaacaaccgctgaggatatcgatcagacgattgaaaatattccctccggaactttcttcttcactgttttcactgatccccgcaacatccactacttctgcatagacatctggcacatgattaccgataactacttggtattgaccgccacttttcatcactgttacgaccccatccatatttttcaagatgtcatcgttcgcgattccttcgtctttcaatttaaaccgcagccgagtgatacagtgggtcaaactattgatattttcttttccgcccacatttgccacgattttttctgctaattcatgatattttcccatttttgtttcctccaatttttgtttgattgaaggtttagccaactgaatgtcactatccaaaaaatgctttactattccccagtttattctgggatgacctcctttcttttatggttagcgattcttttgcaccaatcgcgcaatatgaatcgttaaatacaaactttcatcattggacatatcgtaacgataattcgttaccagaaatgatttgattttttgcacacattgataggcgttgcgatattttatctttaccatctcaaggagctgatcgtcagtctcttccgcatgggtagagtggttctgcatgcgggaaacaaaaaaacgcaaatgcgtagtaaaacgataaaaataaaccgattcttcatcgaaagttgttttaaaatagtatttgacgatattgatgatatcttgcattgttttcgtcaattcataaagattgctttgatcattgttttctgtttgagcgtttaccaaatgcagtgcaatgaaacccgcttcatcttccggcaactcaatcccatagcgctcactaattttttcaatcgttcgttttccgattttgaattcatctggaaaaaatcgcttgatgtcccagagaagaacatttttgacaacgatcccttttttggcacgctcgattgcactatgtaaatgatcaggtaaagaaatatagatcgaatcgttgatcggtgaggacaactcttctcttgcatattcgattacttggttcgaaagttccaaatattctaatggcaagtcggccaataattcctgaaattgggaagcaattgtacgattttctaaacgatatactttatcgatcgtttgatcactgatatcgtcaccaacttttttcttgaatgcgatccctcttcccatcacaataatttcgttttgtttttcatcagtagttatcacgacattattgtttaacactttactgattttcatgttttacccccacttgattattgacgtactaacctatttttatacgagatagccattcaaatcaattttgatccatactccttttttccagaaaaaaaacctaatgagagcagaccaaatagccttactttcatcaggtttagcttgttttttcaacaatcactatccatacgaatgattaacttatccttatgatagcaaacagagaaaacgctgtcaatacattgaccgaaaaaaggattcgttattttacttcctcctgattccttttataaaatgaatcgatgaaaaacaagaaccccacatacccgctcccaagccaacaccaacaaagtgatggagtgatggatacatggaattctagtaattagttagtgtccactggaaggaaacagcaaaaaatattcccgactaatcacacgtcactggactgtaatttatacatatctgcataaaggccttgctgttttaacaatgaatcatggtttcctcgttcgacgatacgtcctttatctaaaactaaaatcaattcagcatcccgaatcgtggataatcggtgggcgatggcaatcgtagttctcccttgtcgcatattcgccaacccttcctggatcaatccttctgtttcggtgtcgatattggcagtagcttcatctaaaacgaggattttaggatcagtcaccatcgttctagcaaatgagatcaactgtcgttgcccgctggagtagctagcgccccgttcaatcactttggcatgataagtgccctccagtttttcgataaatttatctgcttgcacaaatttcgctgctgctcggatttgttcttcgctgatttctgggttcaataaacgaatattgtcagaaatatctccatagaacatgaaagcatcttgtaaaaccaatccgactttttttcgtaattcttcgatcgtaaaatcgcgaatatcatgatcgtcaatcaaaatttgtccctcaccaaattcgtaaaagcgcattaaaacattaatgatcgagcttttgccgctaccagtgtgtcccaccaaagcgacggtttctcctggataagcagtaaaggaaatattcttcaatacatgattttctccatcataagaaaaactgacattacgaaattcaatctttccttgttcaatgacttgattcgcatccggatgttgttgtggggtaaattcttcattatccatgattttaagaatacggctaccagccaccatgccatcagtaaagacgctgagaaaatccatcatctgtgtcataggattgaagaagccttggacataggtggtaaaagcataaatcaaccccacttcaatcggagaatgcaaagcatcaaacccaaacaacgttaatgacatcgcaactgcaatcgcatagagaaaattgatgatcggcgataatagcaacgaattagtacgaatcattgcataccttgtcttgaggtattcatcattcgtttcctcaaattctcggttcagacgtgcttcttgtcggaactgctggataatctgcattcccgagatcgactcgttcaatttcgtattcaattgacttaatttttctcgcatttgacgatagattcgggagctgaatttttgataataccagatgacgatcatcaagataggtaagaaaatcagattcaataaagcaatttttacgttgatctgaaacatggcggcaaaagaagataggactgcaaaaataccagtcaaaaccatcaaaaacacataccagaattcatacaatgtttcggtatcattgctgacccgcgacacaatcgaacctgctggagtctgatcaaaataccgcatacctaaactatgcagcttctcgaataacttggtccgcacatattgatacgtctgcaaggaagccatcgagtatagaaaccattgaaaaaaccagatgactgctttgatgactaccccaaagaaatagagacccgcaaagaaatagatgatttgattggttgctgactgttgtgtcagatagttatccatgaatgtctgcagaattctaggcaggagaatgttgacgattgataagagaaaagcaaagaaaatggctgcaaaaaatgtcttcttgaagggttttgcaaattgtaacatccgcttgatgatcaatttttgctctttaaatggaattgattttgaccattcagattcttgacgttccattatacttcactcccttcaattttggcttccagttgttgcttgtcccacatttttttgtaccagccatttttggctaacagggcttcgtgggtccctcgctcgatgattcttccttcatcgataactaagatctcttcggcatgcttcacactacttagccgatgcgcagaaataatcgttgttttgtcttttcgatagtctcgcaatttgtgcaaaatatcttcttctgttttggcatcgacagctgacaaggcatcatctaagatcagtaattctggatcaacaatcaatgcccgtgcgatggacaaccgctgtttctgcccgccagataatgagacccctcgttcaccgacccttgtttcgtatccttctggcaatgctttgatgtcatcattgattgacgccaaatcagcagccgcttcaaccgcttcttgtggtgcttggggtaccgcaaaacggatattgtctcgaatcgacatggaaaaaagaaagtgatcttggggaacatacccgatagagcccaataacgcattcaaagtataatctttgatgctgtgcccgccaaaaagaatgtcaccctcataatgatcatattcccgcatcagcaacttcaaaatggaggttttacctgcaccggttttgccaacgattcctaatgtctgtccttcatgtaaggtaaatgctatctgttgcagcgtgatttcttcggcatcatgatagcgaaaagcgtctaacgccacttcaattttaccttgagccggctcttggatcgcgtgttttttttcaacaatatgggttctttcccccagcaattcagatacccgatcatagctggcattccctcgttctaaaacattgaacagacggccaatggcgaacataggccaaaccagcataccaatataactaataaatgaaaccaattggccaatcgatatctctcctgacatgacaaaacgaccacccacaataatcgttaagacatatgagacaccgataatcaatgtaatgaaaggatcaaaaagtgcatctaaaaaattgactttacggttcttgatgatggcatcatcaattttggcttgaaaatcttgaatatcttctgtctcttgtccaaacgttttgatgacttttatcccagtaatactttcttgtgctttgtcattaatcgctgaaaaagcttcttgcgaatcacgaaaagcatcatgtagtttgctgcctaacactctagccatgaccgcaagaaatggcaaaggaatcaacgcaatcaaggtcagacgccaatcgataaaaaggatcatggcgatgatcgttgctcctccagagataaacgaatccgcaaaggttaaaatacccgccccagcaacgttttgaatggcgttcaaatcattggtggcatgggccatcaaatctccagttcgatgtttttgatagaaaagatgatccattttggtgaagtgatcgaataattgacgacgtaagcttttttccaagcgtgcagcactcccccaaatatttatccgccagacaaaacgaaaaatatattgtgctaatgcagcggcaagcaaaatacctatccaaaataaaatcgtttctatcgaaatctctttttctgcgatctcatcaataatgattccaatcactttgggtggcgctaattgaacgagagccaccaaaaccaatgcggctactcctatataataatgtttcctttcttgtctaaaaaaccaacctaactttctaaaaatcgacataacaccctcctattattcactcctgttggctacgatttgaatcatcgaaattttcggactattttggcaatgactgaccttccgatgtagttacatttcaattcctcgcgaaacacgttttgttacctacccaacgataggcacaattcatttgctcatctacgcttcgcttacagttcttctaagggaaaatcactaagatgaacttgcatgcctcgctgacgcggtcaatcgcagtgactcgcaacacgaggtattcctcctcatttgcttatctacgctctgcttcgcttacagttcttctaagcgaaaagcactaagatgaacttgcatgcctcgctgacgcggtcaatcgcagtgactcgcaacacgaggtattcctcctcatctgcttatctacgctctgcttcgcttacagttcttctagcgaaaatcactaagatgaacttgcatgcttcgctgacgcggtcaatcacagtgactcgcaacaccgagtaggtattcctcctcatctgctctgcctcgctgacgcggtcaatcgcagtgactcgcaacaaaaagcgagctgatgggatcagcccgctttttgcgctaaaaaacctatttttggtttttcatttgttgcatcatttgccgaatcttcttctcagaaggcttttggcccattgacatcatcatcgaacgcaacatatcctcattaacgggaggatttttcttcagataatcttgcatatatttacgcgccaaaaagaagccgccgacagcgcctaataataccgcgataacagcgatcacgattacaattcctaaactaaccatttgaaatctctcctttctcttgtactctcaatgaatcattttactagaaaaaaatacaaaaagaaagagagaaagcaggatttctccaaaaacattccctctatatatcagcttaatgccacatctcgtttgttgaacaaccagtttgtcaaaaagtagatcaataagctgtataacaaaagtccaatcgtcatttcccaataattcaaacccggatcaattattgcattttgcatatccgtttgatgcaataatgtgggaaccgtatctttgatattcataaaattaaatggattccacttcaaccaaggatatttttctatcgcaaaaagcatgatggagttgatgatgctgctcccgaacaacacagctactcctaatcccactgccatactttgagagcgaatgacggcagagatgaacagagtcatggtcatataaaatacaatcaacagtaaatttgttgctgcatagacaagagccacaactatagctggcaattgattataatccgttgatgtgaagggagattcagataccaaaaacaaattgctggcaagaaaactgcttagaaataaaaccagtgtgccaagcaaagcaaataagagtgtgttgatggcttttgcggctaatatctgacttcttgaaaatggccgaatcaacaaaaacttgatggtccctcgactaaattcttctgctaccgctgaagctgccacaataacaacaaataaattcaaaaatgacgtcatgtcgcttagaaaaataaatagatcgttggctttagtatcaggcgagcctaagcggaccacataggtgagtccgaatgttaaaaccaccaaaagtcccaacatgatccatgtggacttttttttcgtgactttgatccattcattttttattagtgtcctcattctagagccctccctcttccgtccaagccaaaaatgtttcttccaacgaagattgctgcaatttcatttcctttaaaccaatccctgcattaacgagggcagcagcgatctcagaacgattatccgtttcaagtgaaatctgtaatccatccgtcaaagcaagcccatcgatttggaatttagtcttcaagacatttaatgcttcctgatcgtcatctgttttgatgatcagtaggcttttttctgccttcaaggtatccatcgcgacttgatgggtcactttccctttttggacaacgatcagatgatctgcaatctgttcgatatcacttaattggtgactcgatactaaaacagaaacaccctgttctcttaacatgagaatcatttcccgaaactctctcataccctttgggtcaagtccgttcattggctcatctaatactaagagagtaggacgatggattaatgcctgtgccacacccaatcgttggcgcatccctagtgaatacgttttgactttttgattgatatattcttctaaatgaacttggcgaatcaagtcatccatctcaactgccgtcatttttgtcttcgccatgcgctggtattgcatcaaattttcgtaaccagtcagataattgtagaactcaggattttctacaatcgctcctaccgaggcaatggctgctttaaaagacgtttctagggaattccccatgatcgtaattgagcctttattgtgcttcattaagccaacgatcattcgaataatcgtcgtcttacccgcaccattcggtcctaataacccgaccacttgcccttgttccactgagaaagaagcattatcaatgatttgcttggttccaatcagtttaaatacatttttcagtgttagtatttctgtcatttcatccctacttcctattcgctatttttttactttcatgataatagttattactaccatcccactagagtattaaaaagtcaacaggaaaaagaatgatcttttcaatttggtcttcttacttccgaatgaacttcaaagaatacgagccagcttcatcaaattgggattttaaattaatgacatgatttaataaaaaataaacgtagtagaaatcaaattgtcatttaacaaatgatggaattggactgaacatataaatttataaagaggtgttttctccgaaatgtgaataattcatctgctgctaggaaaacttatggaaacttaggctgtcaaaaacctgtttatgcttttcgctccgaattttatgaatcttttctttcaaacgttcccagtcactgctggtgggctgaccattccaataaaaaatctccatttgtttgtttgcccctagctggcgatagattgggtaatcactgattagaatatctggttcatcaactgaaggaacatgctggattgctcgatgggaggtgttcaacaatcgatttttgatccataattcttgtgtcttgccaaatttcgattgaatagaaaaagttactggacgctcatatttaataaagactgttcgaacgagcatgcagtattgaaagataagacgatcattcttctttgcaaacccgacaagtggagggatttctctttttattgcgatcaaaaatcgtctcatcgttgggtacatgactgggaaataagcttcaagctcactttccctcgtttgttttccaaacccatctattttatgttctgttccaaaaactgatgagtaggaatgaatcatgagtaagttgaccaataaataatttttttctttcgaagtgagtgccaaatcaaagtatgcagacagtttgtcaataatgatctcctcagtcgaatactgctcattatcaaaccaatcctgatggatttcagtcagatcctcttccaaatatgtattcattactgcaaacataaaataaagaaaactgatttcttcgtccgtgagatcactcacagcgtaaacatttgcctgaaaaaaaggtgccagtatgcattcggtgaactttcttttagtcatcaatggatgctcgaaagtcgttatttcatcaggaatttctacgataaaatgtcgctgtttgattcgctgcaatgaaatagccagcagagataaaaatttattgcaatcaatttttcgcatgtaaggagcgtgacgctcaatttgagtagcaatagtttgcttgtcccttatcgttgctaaaagatctgagtccgtttcatcaaacaactgccaatacatgacatgataaaaataacgtatgtagtactcttttccttcaagtggatttccttttcttaaactgtatgataaatgataatttgctaacacttgattcaattcagtcaattttctttgaatcgtccgtaaactgctatatgtctcttggcttaattgctctaatgagtggtactttcccttaaacaacaaatcaagaaaggtaaatccgacagttctttccaccaagattgcataaactttgcttagcagaaatctaggtgaaaattctatcttgatagtttttgattctgattgataattaaccgtatactcagaatattgctcctgaaataattctacctgttgaataacagacaatagcttgctagttttatagttaaacacagccatcagctctttggttgaataagttgtttgattcctttcataacaataggtgagaaactggttgatttgtttttctgttgtgtcaaataatacatgaaacactgattgaccctcgcttaaatagttattcaaactttgccttcatttaagtttgatttcatctggacaactaaaaagatcttacaatattgtaagttagtgaatgttttgcgatcataccacttcaaaggaacgattgtcaaactacccgtcaaagtcttttattaaaaaatatcagctcaacaaatcttgcgatttgttgagccgaataaattgtaactgttcatttctggggaagaaatttccaatcattttgcttgttctgcctttttgcgacaatctctcaggagagtttacatgccaatctgactattctttatttacttcattatcagcagcgaccgcttttttatttacaatattaaatgaacttcttaaatgtctttttctgttctgagtgtttgtcctgccacaattaattttcatcattattatcgtatgaggaaagactattgggattgctcgtctccttaagtatactagtgtcaatgctggaactctcagaagaagacggtagatcaacaatactccatttacttggctttaaattctctatagttgtaacgtcaccatcgtaaacaatcactaaatccactttgtttttacacttgatctcagacattggtaaatctccacgaattcttaaaaaattctcaataccggaaacccattctacattcgttaaagtcgtttcaccaatgacctttttctcagtacccttaccatcccaaccataagttaacactgctcgaaccgatttggctgatcgtgttttattcggacgaataggtatcgtgatccactttgactgctcatcataaatgatacggttcgttcgtaaagtcaaagatagtttaccgggagctcgttcatttgccaaactatctattttaaagaaaacaataagtaaaataataaaaaaggcaatcaacaaggggattttattcatttgctcacttcctaaatctatttcaggttaacttgataatgagattatagtagtttttttagttaaccacgcgccaaaaaaaagacagaatcaggtggaaattggcatttttcagaaaacaaccaaaaaagactgacacaagaaagacaaaaagtcgcagcgaattcttcgaaaaatccagcagcaaactaccactaactagatcaatattttgtctcttcttatgttcagccttttaaatctgtaaggatattagatttgaaacgatacattcacacgttcatccaatctccaattcattttttctttttattttcgtttatagataacgtaagaaatcaaaagcatgcccccgagaatcatccatttatcattggtcattccggtttgcggtaattgaggattccctccattctttggcggtgccccactctgacttactttaggagcggataatgaagagttgtccacgctattaccattactgttggaagtcgcactctcgctacttaactattggtcgtactttcgttacttgtgctactcattgtactctcactgcttgcggtcgtactttcactacttgtgctacttgttgtactttcactgcttgcggtcgtgctttcgcttgaagtgctcgtttctccggtaccactgcccccgcctccatatttcggcgtgtagccagtagttgtgtggactgctgctgaatcattgatcaatgcttgaatggttcccttgtttgtatattgctccaaagacccatcagtttctgttttataggtgatatagattctctcactcgtatcccgcaaaggaatttcaaaagtgccgtctgaattaagcgtaattgggacttggtcaacataagtgggattagttacgcttggaccttacaccactcgtgccgtggtgctgatcaatgcttgatggggtccaagagtatcaatgaatctcccatttttaattgaaaccttattcgtatcataagaattgatataaatacgccaatcaatcgttcgtttgggttcttgtgtgcctagataaagcccttgtttcgtaagtaatgcacctgttccagtatcctcaacccctcgaataaataaaggaattgtcttaattccattaactgtttcaaaatcgagttgattgatctgatcgacggtaatgtcttcactaaattttgtccaaaagtaaaaatctccatgcacattgttgttctgctcaacaaactcagtaaatacaaaagtaagctgattcccaacttgggtgagatttactactaaatgaccgttctcatcatacagttcatagctattattgacaccttcaatctctactgggaggataatcgtcgctttgtccccggcctttaagtcacctaatccttcgagactccatttgagatcaattttgaaagattcgtcttcatctaaagtcgtcacttcttgattctgactattgacaacggatacatcagtgattaagtttgcccccacatccgtctctccgtatacgatttccataccggtaaaaatggggatagttagcaacagagcaacaagtacttttgcaatctttgaaagcatgtgatccctccctgatagttaataggtcaccgccagtataatttacggaaaattcagaagcaagtcatacgaactgtgcgagttatatcacaaggcagggcttcactttcaaattaatcatctgcttttcacagaaaaaaacctatcactcaaacaaagcgataggttttgtaaaaagactgactgattattctgttggatctgcatagcgatcaatttgttgattataacgtagttgacaacaaatataaaaaataacttggaacaataagtaaatacctacgatttcaccatagaactgccaaacgggcaattcaactaataaacgcagtgcggtcatcgcaacagcaaaatgaatcattgccacgatagttggcaaaaaatacataacttgtagctgatgacgcagaattttatgccgttcttttggtgaaacaccaagcacatgcaaagagcgatggtaagcgccgtccttgtcaagatccgcaaacaggcggaaatagatgattgatgcagagaaaataaagaaaacggagcccagtaaaacagtgatcattaaaatgagaccattgccttgacgtgtttcctggaaaactttgtattttgattgataaccaatatgagacggaatgccttcaagtgcttttgaccactcttcatcggacatctcgttgactttgtctgctcctaattcatcgtagatagcggatactttttcatctgtttctttattttcttgatcgatttgctgattgataccatcaattaacgtaggatcgtctgcccactcggggtaatctaaccaaacaaatcctcccgaatcttcagaatcaccaatttctttttgccacttctcaaaagtttgatcagttacaacaccaaggccaaaatagttcaacgaaagcattgagggactatgaacgatcgtcatatcttgctgaaaatcgctatctccgccaatttccagcggatacacatgttgtcgttggctttggtcaaccgacaacagttctttacgtcttgaataattgctgctaagttcaagcacttgatcatccataacaggttcagctttttctccgatttggctcatcaatttgcgataatcactttctctcatcaatgaaaatgcattgttcatgtaatatggatcaatagcaatcgctggattttcaagatttgtgtaggtctcaatgagatccacttgttccataaccggatgatagccttgcgcttccaatttttctttcacttcaaacgccttcgttttacctatttcatctttttcgtattccgaaaaaacatacgctacactaattccttgaatcgaagaaaacgaagtgttgccaatcgccatcattactgctattcctacaaaagccactgatgtactaatggcgatcagactgtacattgccgcattgtcccgcatacgaaaaatccattcactaatcgttaacaagcgtgttccttgtaaaaaagaaggacttcttttaagttgtttcaataagtaaacactaaactgatagaaggacaagatcgtgcctgctaccgtcaacaaaacgcctaataaaagaatcaaaaaaccgtcagctttgaaagaaaaataaaacacacatccgtagccgacaaagagcaaaagcaccccaaggaatgcatagatccgacgactcacaggctccggcctgggcttctcgttttctttgatcaatgatatgatcttttccccttgtaaagcacgcgtactaaaaaatgagatcagcaggaacatcaaaagatacacgccgattgttaatcccaaactagtcaatggaaccataaaagacaatccgcgattgagatgcattacattctgagcaacaagcaataatagctttgttcccaaaattcctaagccaacccctagaaaggtggccagcgatcctaataacgcattttcaataaatagaattcttcgcaaatccttctcttcaatccctaaaatgagatagatcgcgagatcacgtttgcgacgttttaagaaaacaacaaaggtgtaccaaagaaacatcaaagataaaaatgcaattactactaaagcaaccgctaatcccatcttagctagactggaaatggtatcgctcgctgacaagttttcttttagttgcggatggaacaaaagcagactaaatatataaaaaaccatggcagcaaatgtactgcttacgaaataagcagcataggtgcggaagttacctcttaaattacgaatgatcaactgtctgaaattcatgacggcgacctcctagatgtgcaagaacatcaagaattttttggtaaaattgttgctgatcacttccgcgataggcctcattgtaaagtttgccgtctttgatgaaaacaacacgatcagagaaacttgcggaatagggatcatgggtaaccatcatcgttgtcacttgtcgctgtttgttcattcggctcaaaatttccatgacatcacgggctgctttagaatctagattacctgtcggctcatccgcaagcaacagttctggctgatgtatcagcgctcgagcaatcgcaacacgctgctgttctccaccggacaactgatagatccgtttttttcttttgtcattgattcctaactctgtcaaaagcgcttcacagcgccgtttcatctcatcaaccggtactcgatccaatgttaagggcagcataacattctctgccacatttagcggagacaataagttataattttgaaacacgaaacctaactgtcggcgtctaaactcagcaagctgttgttttggcaatgtcagcggttgggcgccattgatgatgaccgagccggatgttggttgatccagagtcgcaactaaattcagcatggtggttttaccactgccagaaggacccataatgctaataaattctccggcaggcactttgagatcaatttgtttcaacacttccacagatacttcaccagtatacgttttagtgatatttttcaactctagtaaagccatagcactcactcctttgctgtcagtgtaacaggttttctgaaacaaacttatcgattgtttgaaagataacttacaattttgtaagtttcgttagctctcgggaaattttaattgcaggacagtcccttgaccgacttcagaagcaatcgtaaccgtaatcgagagtttttgactaatgagagagactaaatagagtcccataccggtagcttctccccgctgccgtccattgtcaccggtataaaaaggtcggaacacccgtggcaaatctgccgctgaaatgccacaacctgtatctgtaatcgtcagacttctgttcgcatcatctaatgcaaaagtgactgttgctttcggattcgagtatttgatggcattactgatcaattgaaaaagtagaatctgcaaccattttttgtctgttgttatccaaaaatcagtctcatccttaattttcggataaatttcatgccggatgaaattgcgcttctgttcaccgatgctttgcttgatcaatgctaataaggaggttgattcaatcaaaaagtcttcttcaaaatcttccagacgaacaaaattcaaggctgtggctaatccgcttttcaaacgatccgtctctgctaaaagatcgtaagggtcaatttgactactctctgccatcagttctaggactgagactggtgttttcatttgatggacccagatattcataaatttgatatgggtttgatgatgggcatcaatcgctgctagttgctcttgtacgtgatgatggtcgtcatctaaaagctttttgactcttctagctaagtaaccagcgcttcttccagataatcctgtttttagatagtggtagaaactgcgattggcgagataatcaatcgtgaaaactcctatcgctaacaagcccactaatagtaagccatagccgatcacaaaaccattgcgatacccatctaaccaaacgagcaaaaggatcaaagcaatcgacatcccaaataaagcaattgctggtaattgaactttcaaatattctttcattctggtctcccggcaataaaaagagcataaccctttccacgaatcgtttggattggttcatcaagaccgagacttaccattttttttcgcagacgaccaacatttactgacaatgtgttatcatctacaaaacgttcatcgtcccataatttattcaagatctgttctctggagaccatttctggataagccatcattagtaaagtaagcaattctccttcacgaacagttaacacttcttccttttctagataattcatctttaaagcctcaggataataaatcaattccccagcttttagttggcgagcacgattgctctgtgcatagtctccatatactcgccgaatatgactttttatttttgctaagagtaattcataagaaaacggtttgatcagaaaatcatctgctccatactcaagtgccatcacttgatccatattaccgtcacgagccgaaataaacaaaatgggtaccaaggattgctcgcggattttttgacaccaataaaaaccatcaaaaaaaggtaaattaacatctaacaaaaccaaatctggctctattctatgaaattcttccaagatcttttcgaaatcctgcggaataaaagtctcgaaggcatagcgagacagctgactttcaatcattttgactaatgacttttcatcttcaattagaaatattttcacagtgcacctcctaaagtacttctagtttaccaaaagcaacggatcacttccttaaaaaaatcagaaaaagattgtccacttatttattgtaagcaaaatgattttatagtaaactatttctcgtgacatgttaaatatatctaaaaggtggaaaattgatgaaaaatgttttagttgtaaaagcaaataaccgtcctgacggagtatctgcaaaaatgttcgatacttttgtagaaaatctagatcgaacagcagtagatgtagttacttttgatgtttacgcacaaccaatgccttatatcggacaaacattgttcgaagcattcggaaaattagcacaagaacaagatttaaaccaagaagaacaagaattgatgaccgtccgtcaagacgtcatgaataaatttgcagcagcagatacgattgtctttgcatttcctatgtggaacttgacgattcctgcggcattgcacacatttatcgattatattttccaagccggtttcactttctcctacaatgaagatggatctatgaaccaattattgaaagacaaagaagttgtcttgttaaatgcccgtggcggtgtttactcaggtgaaatgagcggcatggaaagtgctgttacatttatggaaaaagtatttggtggtatgtttggcatgacgatcagcgatgaagtaatcattgaaggtcacaatgcagacccttcaaaaactgaagaaatcattgcagccggcctagaaaaagtggcagaagcagcaaaaaaattctaataaaaaattaaaaatctcaggaatgataagcgaaccaacaatgcgaactagcagttatgggacagctttattcctgagatttttttattactgttaaacaagaccgtctttccaatcaagtggtaaaagctgagcaagcggcagactgcccgccttcgtcaagacttgcgcagaaagattgtcttcagacagctgactgagaaactcgcggcaacgaccacaaggtgagatcggatgcccctgccagtccacagccacaacttttgcaatgtgatgttctcccgcagtgatcatagctgctgcagctgcatgttctgcacaaaaacccatagaacaactagtgtcaatgcacactccagtaaaaacgttcccttctctggtaaggatggctgctgcaacaccgcctgattctgcccagggagacagttttcttggtgcaatcttcgcttgggcgaaagtaatcaattcatcaaactccatctattcctcctgctaaacccattctttcttcaataatcgaaacagttccagactaggttagactttttttacgccataggataatgtggttcattgctccatgatcttagtcaacaagtctggatcaaacgtttgttgctgcagcatggcgatttcaaaaccataaggagcttttttattctttttgtcttctccaacataaggagtttctaaaatttttgggagttgcttcaattgttcatgatggacgattttattcaatgcttcaaaaccaatcgttccaaaaccaatattcgcatgccgatctttatggctgccttggggatttttggaatcattgacatggattacttttaaacgttccagtccaatgaccttatcaaactcatttaagacaccatcaaaatcttctttgacgttatatccagcatcattggtgtggcaagtatcaaacgtcaccgaaagcttctcattcagcgtaacaccatcaataattgcagcaatttcttcaaaactgcgtccgatttccgttcctttaccagccatcgtttctaaagcaatctgagccgtttgccctttttccaagacttcgttcaatcctttgatgatttgcttgatacctgcttctggccctgcaccaacgtgagctcctggatgcaatgtgatttgcgttgcgcccaatgcctgtgctcgttgaatctccgcttgtaaaaacgacaccgcaaagccaaaattttctggtttgatggtatttcccaaattaatgatataaggtgcgtggacaacaatattcgaaatgcctgctttcgtcatgaaatcttgtccagcagcaatattcatctcttcaattttcttacgacgggtattttgtggagcccccgtataaatcataaaggtagttgcttggtagcttgctgcttcctctgccgctcccagcaacatttttttcccactcatggaaacatgtgatccaattaacattgattgtcttcctcctaaaaataagtcttgtctattatgcgaaaaaacattcattcacgctagttttttgcttgccgttttctttgactttatccactatattaagccaatccaaataaaatcagtacgagtgtcatgagaggcaaactaatcaagaaactgatagaagacacaaagccgactgcctcttcctccatacctgccaatacagaattgatcacaccgaataaaggaattggagcaaataccagtaaacacaacacgggcttcaaaaaagcgggaagaggtaaaaagaaaaagcagagaaataatagcaaaccgattccataacgcaaactcaaaatctttcctaccgttgcagcagcatgtttcggtaaacgaaaatctaaaaacaaaccaatcatgaacatcgatagaaaggtattggcattaccgataggttggactagctggatcaccccttgcggtaatgagagcccaaagctgcggatcagcaacatgaataaatagcaagtaaaggttggcgatcgtaataaattaagaatgatttttcctggctcaaaaactgtccgtttcccgattagatactcaatcaaaatggtggtgcctcctgccaacataatactgttacccatatcaaacaatgaaatcaaggggattcctaatggataaaaactttgtgcaaaaggaatcgcgaaatttccgatattgaacccggagccacaatacatcgaaaactgacgtaacacatcattctcttttttggttaggaaaaaggcagtcataatctgcacgaacgtgatgattaccgcaattaaaattaatgccagtgcgtccatttggatctgcatatcggcaagattaagaatgattgctgctggcagagtgacattgaggatcatccgagacagaatagatccatccgcttttgataggacctttagctgtttaagaaaataccccaaaaagatcattgcaaagagaccagcggcattcaaaaataattgtcccataaacgatctgtttcctcctctattgatttgaaaaaaagcgaacccactcagcggttcgctttttactcatttcactctctagcaactagctaaaatgtcaacaagaaatattttttcttcccacggcgaataacaacatatttgccgccgatacggtcttcttcgttgatcacgtaatttaagtcttgttggcgttcgccattcacatagattgccccgttttggatatcttcccgggcttgtcgtttcgatgcttcgattttcgaagtagtcaacaattctacaatgtttaactcatcatcattcgagacttgataggttgggacccctttgaatccttgtgcaatttcgtcagcagacagtcctttgatatccccattgaacaagctttcagaaatatgaacagcttgctcatatgcttttgcaccatgaactaatgtggtcacttctttggccaacgctttttgggcaactcgtgtttctggtgcagctaagaattctttttcaattgctgcaatttcttcaagtgataagaaagtgaagtatttcaagaatttcacagcgtcacggtcatccgtattgatccaaaactgataaaattcgtaaggtgttgttttgtcggcatctagccaaactgcattcccctcagttttaccaaacttggtaccatctgccttagtaatcaaaggcatcgtcaaaccaaacccttggacttctcgttcgcgacgtagcagttcaattcctgacgtgatatttccccactggtcactgcctccaagttgcaatagacagccatgttcatcataaagatttaggaagtcataggcttgcagcaattggtaagcaaattcggtataagaaattcccgtttcaatgcggcgttttacgctttctttgctcatcatgtagttgatggtaaagttcttccctacatcacgtaggaaatcgatcaattttaattcgcctaaccaatcataattattggctaaaattgctggattcgtttgatcctcaaagtcaataaaacgagacaattgatttttgatactttgagaccattccttgacggtatctaatgtatttaattgccgttcttggtccttgaaagatggatccccaatcatccctgttcctccgcctactaatgcaataggaacatgtcctcgttgttggaaacggcgcagcatcaagatcggtaaaagatggccaatgtgcaaactatcagcggttggatcaaacccaatatatagtttcacagactcttcgtttaattgtttgatcaatgcactttcgtcagtagtctgatgaaccagaccacgactttttaattcttcaaaaaagtctgaactcattttttttcctcctaaatcattactcactgttcatattaactgaaaatccgcctaaagaaaagccttaatcccattttggatcaatcccgtatttgttataatttgattgtgataacgagcaaaactatccaagtgcgttgatttttgctataatacaacggaatctattctaatatcattgaggtgaccatttttgccccaaaataagaaaaaacaaccaaaatctccaagtacgaaaaagagctggttttatttcaatatcagcttgcgcgtgctccattcgctctttttagtcgcaatttccttttcgattctgggcggttcactcgcactaggtatcggtgttggctattttgcatttttagtagaagataccgctgccccgtcaaaagaagaactgcagcaagaattaaccgacatcacagagacttcacagctagcttatgcggatggtagtaaaatcgccacgattcgatcagatctgatgcgtacatcggtttcttcagataaaatttctgattatctcaaaaaagcgatcattgcaacagaagacgaatatttcaatcagcataatggcgtcgttcctaaagcggtcgtccgtgccctcctctctgaagcaactggctttggtggtggcggtggatcgacattaactcagcaattagtcaaacagcaaattctctcaagcgaaactacttttaaacgcaaagccaatgagattctcttggcgatggaagtcgaaaagtttttctctaaagatgagatagtcacaatgtacttaaatatttcaccatttggtagaaataataaagggcaaaatattgccggcgtgcaagaagcggcccaaggaatatttggcgtcaatgctgccgatcttacacttccccaagctgcttttattgctggattgccacaaagcccgatcgtctatagtccgtacacgaatactggtgaaatcaaagaaaatctcagtgccggtttagatcgaaaagacttcgtcctctttagtatgtatcgtaatcatgacatctcaaaaaaagaatacgacgaagcaatggcttatgatttgaaacaagacttcaaaaaacaagaagccattgagcagaccgatcagagtttcctctattatacggttctcaatgaagccaaagatatcatcgctaaacaattggcggacgaagataaagttagcgcagaagaatacagtaaagaagaaacctatcagaaatatttagaattagcacaacaaaaattagtcaatggtggttacacagttacctctaccattgataaaaacatctataatgccatgcaagacgctgtgtccaaatatggctatatgctggataactggggcgatgcgcccattgaagttgggaatgtcatgatggataatgcaacaggccgtgtgcttgggttcattggtggtcgcgattatcagcaaaatcaattcaatcatgcgttcgatgcccaaagacaagctggatcaagtattaagccaatgctcgtttacggtcctgccatcgatgaaggcttgatgggttctgaatcaatggtctctgattacgcagctaaatggcgcactggtgaaaatgcggatgaaccaatcgttaacgcgacaaataagggaaccaatacctttatgtcgattcgagaatcattagaagtctctagtaatatcgctgcgacaaacatttttcaagacatttgggagcaagaaggtgacccattcttctcttataagaattatttgagcaagatgaactatcctgaagacaatagttgggcttatgagtctgctcctttaggagtcaccaacgtaactgttttaactcagaccaatggattccaaacgttagcaaacaaaggcgtttaccaggaaggttatgtgatcgaatcgatcaagaacaatgaaggcgaagtcttgtatcagcatgaacaaaaaccagttcaagtcttctctgaagcaacagcatcaatcatgaatgacatgatgcgcagtgtaattgacgaacaaaagacgtctaactttaaatccgttgttagtggtctggattggaaccttggaaatgccgattgggtcggtaaaacaggttcgacaaacaattggtccgattcttggctcgtggtctcaactccttccattaccatcagtagctggtctggtcgtgatgacaacaaagccaccgatagtagtgccggaacacgtaccgctcaatacatggcttatttgatcaatcgcatttatcaatccgaccagaaggtctttggagtggataaaaaattcgagttatccgatgatgtcaaaaagatcaaagtgtctaaggctacaggaacacttccaggcggcacggtcacagtagataacacaagaagaaccaatccaagcgacacagttacttcgtattggacaaaaggcggtcccaaagaagcatcctttgaatttgggattggcggatcgaatgccaattatgcagattattggaagaaaatcgcccctagccgaacaacaacatctacttctaccaatacagccacgaacaatggctctagaagtaccaataaagaagaaaacgccacgaacaataacaataatcaaaaagaagcagaaaaaacggaagaaaagaaaaacgagcagaaagaggatgactgattacgtcatcacagtcatttgccaaaatctgttttacctgaagaacgggaagcacatcgttgctcctgttcttttttatatctatatgtaaataaaaaaaccgctcctaagaacggtttcttcttttttctcacttatttcgttgaactcttttcagagataccatatggtaaaacaattgttttttgttctacttcttctttgttcatcattttcgttagtaaacgcatcgctacagcacccatgtcatataaaggctgtgtcacgctagataaacgtggacgggcagcttctgccaataaagaattgttggctgtaatgatttcaaattcttcaggtactttgacacctcggtcaatcaaaccgtctagaacaccgatagcaagttcatcgtctgttacatatgccgctgtcgctccactgttcatgattcgttcaactaatgccaagccttctttaaagctataaggcgcttcaaaaatcaagccttctgaatagtctaagttgttttcttttaacgcttctttataccctttcaaccggttttgaccgttgattggatcaatcaatgcaccgctgacaaaagcgatcttttgattgtttttggctagtaaacttactgcatctttcgtagctgctgtataatcaatgttcacgctccccacttgttcatcgggatcgattgagccagcaagtaccactggtgtttttgaacgcgaaaattcgccacggatttcatcagtgatccgatgacccatgaaaatcacaccgtctacttgttttgccaaaagattgttcagtacgtttacttccttcatactatcgccatcggaattcgccaagataatgttgtatttgtacatcgttgctacgtcatcgatcccacgagccaatgaagaaaagaacatattgctgacatcgggaatgattacaccgactgtagttgtttttttgctagccaatcctcgtgcaacagcatttggacgataatctaagcggtcaatgacttccagaaccttcttacgtgtcgctggcttaacatttggattgccgttcacgacacgagaaaccgtcgccatcgaaacatttgcctcacgagcaacatcataaatcgtaattgtttgtttttccatgatatatctccctttattctgttttcagaaaatcttatttacatttctttgatagaatagcaaactttttgcgaatatgcaaccgttttaattccgctttcatgaaaacttagtcaattttacatatttacggacaagcattctccagtaaagcgtgctaaaatggagaaagaatacttgaaagaaggttttttcatgaataaagaaaaaatacaagaaatgacaacgtggttagccagcaatcaagctgaggtcgcttatatctcaaatccttcaacgattgcctatttttcaggtttcaagagtgaacctcatgaacgcgtattagcactctttctttcacctgataaagaccctttcctatttacaccagctttagaagttgaagaagctaaaaatagtggctggccctacgatgtgattggttatttagatagtgaagatccttggaaaaaaatctgttcagagctagaatctcgttatcacctcaaacgattagcactagaaaagaatgatttgactgttgaacgtttcgaagcattgaatggtttccttccaggaactgatttttcacttgatatcactcctgtgatccagaaaatgcaattaaccaaaacagcagcggaaatcgacacattgcttgaagcaggtaattgggcagacgtcgcttttgagattggtttttctgctgtcaaagaaggtatttctgaaatggagatcgttgcagagattgaatatcaactcaaaaaacgcggcgtttcccacatgtcctttgatacgacggtcttagcaggtgccaatgctgcaagccctcatggggttccaggtaaacaacaaatcaaaccaaatgaactagttctcttcgacctaggtgtgatctggaatggctattgcagcgacgcaacgcgtaccattgcctatcacgagccgactgaattgcaacgaaatatctatgatatcgtccttgaagcggaactgactgcccaagcagctgttagaccaggcattactgcgggtcaactggacgaaattgctcgtggggtcatcgaaagtcatggatacggtgaatacttcaatcatcgattgggtcacgggatcggcacaacggttcatgaatttccatcattgattaccgggaatgatttggtgattgaagaaggcatgtgtttctccatcgaacctgggatttacattcctgaacaagtcggtgttcgtatcgaagattgtatctatgttactgaaactggttgtgtgccgtttacaaaaactgcaaaagagctactagtattgaattaaaaaaggagatggattatgacgcaaaatgtattggttttaggtgggacacgcttttttggcaaacatctcgtcaatgaactgcttacacagggtgcgaacgtaacgattgctactcgtggaaaaacaccagactcatttggtccaaaggtaactcgattgatttttgacagagaagatgaagacagtatccgatctgttttgacaaaagaaacttatgatgtgatttacgataatatcgcctatacctccaatgatattgatattttgatgcgtcatgtcactaccgaacgctatattgtcacaagctctatgtctgtttatccaactttccatgacaatctggtcgaaaaagattttgatccaacagcacatgcttatcgtcttgtgacctcagaacaagtgaactatgcagaaggaaaacgcagtgtcgaggagattttaagccaaaaatactcacaaaattcggcatttgtccgctttccttatgtggtgggaattgatgactataccaaacggttgtctttctatattcaatccgtttgtcaaaaaaaagccatgtttattgacaatctttcccatcaaatgagttttatcgattctaaagaagcaggaaaatttttagcatttttaggaaccagttcctttacaggccccgtcaacgctgctgctaaaggtaccctctcactggcagaaattttagcttatgtctcaaaaaaaactggcattgacccacttttatcacctaccggagaagccggaaaatacaatggcacgcctgaatattcgataaatgtagcactagctgaagcaaatggctttcaattctcccaactatctgattggatctactcactatgtgatcaagagatcaaaaacgcttaactatgtgcgccttcgctaaaaaaaacacatccaaactagaaataaatgcgtctgtgatctgtttgatcgcaggaaccgtgttgtcacggctcggcattttatcttcgtttggatgtttttttgctaccgattaaaagcagctcctttaactttcaaaagagaaagattatgcttctggattatttttttccattttatcttttaattcttctttgacttcttcaaaatcttctttcgcatctttggcttctgattttgttgttgcttttacatcagccgcttttttatttgcttcatgtttcaattcgtttgctgctgattttgtttcttttgcagcatcatctacgattggtttggcctcttctgccccttcttttaccgtttccttcatgtctgcagcggaagattttgcatcaataaaaatgtcttctgctgtttcttggacgtcttcatgaagatcactagcagaatttttgacttcgtcagcagattttttgaagcgctcagataaatctcctgcctgtttttttaattcttcaactgtatcgctagaagaactagctacattatcttttaagtcatctacttttgcagtcaatgaatcagtaaaacctgaagcttgttcgccaagtttagctgctttatctttagcgatctccactaaatcggtacttttatctttagccatatcaccataatcagaagctttatccaataaatcatcggcttgtttggctagtttgtttcgcaagtttttacctgactcgggtgctaataacagggctgctaccgctgctgctgtcccaccaattactgcacctaatagaaatccaccttttttactcattgaaattcctcctcttattgttgtttgttacggtctttgaaaaatttcattgctgtttgacctactttaccagcaacagttgctttagccgttgttcgacctaaactgccaactcgcgagaccaagttctttcctgaactattcaattcagagacgctggtacttaaatctgctactgcagtaaagagcggatcaatggtcgcaactttgccatttacatcctgcagcaattcattggtcttaaccaacaatccctccacttcttttgaaaggatatctacgtcttgggtgatgactcgaatcgtggtattggcttcttccactgttttatccactttggtcatcgttttgcttacttgcatcaataatcgtacaacaaaaacgacaagtacgacgaatgcaatcgcagcgatcaatgctgcaatctctcctcctgtcataaaatgtctccttccccttttacttatattaagaatagcatttcaaacggcgttctacaaataaaagactaacgaattttgttttttttactaaaatctatccgctttcatacaaaaccaaaaaaatgccgaacaactttgattgatcgtcagttgttcggcaagcgttcttcttacttgttctcttttgttggttttggctgggttgctgttttttcagttggtgttaattctttactcaattcaatcaagtattcttttagactgtctttgacttctgggtgtttcaagccatattcaatgcttgtcttcaagaaaccaaatttatcaccaacatcataccgtttaccagtaaattggcgagcaaatacgcgttgtgttttattcaacgtatcaatagcatcagtcaactgaatctcattgccggcacctggtttttgattagctaagatatcaaaaatttctggggtcaacaaatagcggccaataattgccaaatcactaggcgctttgtctggagcaggtttctccacaaagttcttcacgttgtataatcctttatcaacttgcatgccaggatcaataatcccatattttgatgtgtcttcatgcggaacatccatcacagcaatcgttgaagcatgcgttgtttcgtaatcatcgatcaattgcttcgttaatgggacttcatcttccatcaagtcgtcgccaagcattaccacgaagggctcatttcctacaaaggctcttgcttgtaggacagcatgccctaaccctttaggatgtgattgacgaatgaagtgaagattaacatctgtggtttcttcgaccaatttcaataattcagttttgcctttttcttgcagattcatttctagttctaagtttgcatcgaaatggtcttcaattgggcgttttgcttttccggtaacgatcaaaatatcttcgatccctgattgtaaagcttcttcaacaataaattggatcgttggtttatcaacgatcggcaacatttccttagccattgcttttgttgccggtaaaaaacgggttcctaatcctgctgctggaataactgctttttttacattcatttgtctctctccttatcgttacttttcaagcgtaaactcgttctcttctttgccatctctcagcatgatttctttggctgcttgttcgattgcttttccttcataaagaacagaataaatggtttcggtgatcggcatttcaacacctaaagctgctgccagttctcgcgctgcttttgtcgtcgatacaccttcaacgatcattcccatgttttctaatacttcatccaaactgtgtcctttaccaagtaagtttcccgcacgccaatttcgtgaatgaacactcgtacaagtcacaatcaaatcaccaacaccactcaaaccgataaaggtcaatggattggctcccatagctactcctagtcggctgatttcagctaacccgcgggtcatgatcgccgcttttgcgtcgtctccaaagcctaaaccagcaattgctcccgcaccgattgcgatgatattttttaatgctgcaccagtctcaaccccaattacatcattgttcgtataaatacggaaatagtcattcatgaacaattcctgcacatattttgctgattcttcattttcactcgctgcagtaatggtagtaatatcatggacagccacctcttctgcatgagaaggcccggatagcacaacaatatcttgtcgtttctctgtaggaatctcttctgccaaaatttcagatattctcttgtgacttccttgctctaatcctttcgatgcatggatgatcacgggacgattggttgccttttcggcaaactctttagcgaccgcccgaattgctttcgtcggtacaacgaaaagaatggcatcagcatcaatgatcgcttcttcaagagccttaacacctaaaatattttctggtagcttcaaatccggcagataatgacgattcgtatggtacgtattgatttcatcgatttgagctggattgttgccccaaattttcacttcatgaccattctcggataacacttgtgcaagcgcagtcccccaagagccagggcctaatacggctattttttgtttcacgatggaaacctcctctgttcatttacaataaaacttcactcaatcattttaccatagttgccgaaaaataactgctagattacatattcattttctccataggaacggttgtaatcttttacttttgtttttttacggcgccagatcaagacgatgattgcaccaaagaataacacagctgataagacttgcgatactcggatcggtccaaacaagtacaaactatccgttctcattccttcaatgaagaagcgtccaaaaccgtaccagatcagataccctaggaagacttcgccttcttttaaaagtccctttttcttacggagtaagatcaaaacaataaaacctaaaacattccagacagattcgtataagaatgttggttgtcgataagctccatcgatattcatattatcaataataaaattaggtagatggagactttctagaaaggaacggctgacttctgcgccgtgagcttcatgattcatgaaattcccccaacgtccaattccttgtgccaacaacacgctaggtgctgcaatatccaaaaaggtcactggtgaaataaaattgcgtcggcaaaagaaatacagccatattcctccagcgatcaaagccccatagattgccaatcccccagaacgagtattgaaaatttgaattggatctttcaaataaggttctaaatcaaataggacgtaatacagtctgcccccgataattgaaactggcaagccaatcaacataaagtccgttacatcatcggccttcaatcccacacggactgcttctctcgtactcaaccacatcgcaatgatgacaccggagacaataatgatcgcataccaatagatcggcagaccgaacaactcaaaagcaacacgatttactaaagctaacatataaactgttcctctctaatttccagaattttcttcgatcaactgtgtcaatcgattctcaaacgtttgtgtcgcatcataacccattgtttttgcccggaaattcatggctgcaacttcaataatgatggcgacatttcgtccggtttttactggaatcttgatttgcgggatatctacttcaccaatctgaacagttgtatcatccgtacctaagcgatcatattttttatctttagcccacgcttcaaggtaaactgccaactgcacttgcatatagcctctgactgcactggcaccaaataagttcatgacgtcgataattccgattccgcgaatttcaattagatgttggaggattttgggcggttctcccaccagtgtcagttcatcttgcttataaacatctactcgatcatcagcaatcagccggtgtccacgcttgatcaactctaatgccgtctcgcttttcccgatgccactatctccttgaatcaagacacctaatccataaacatctaccaaaactccatgtacgcttgttcgagctgctaatcgtccatctaaatagctcgaaagttcacctagcaatcgtgaagttgaaataggcgaacgcaaaattgcgatattgtgctctgcacaagcttggatcatttcctctgggatagccaatcctctggaaacaatgaatccaggtgtatcttctgaacacattttacgcaagaccatcaaccgctcttccggcatcattcgttcagcaaaagtaatttctttacttccaaatagttgtaatcgatcatgggaataataattgaaatagccggtcaattccaaccccggtcgcgaaatatccccggtgatgattgtccgttccaaacttgtttcatccccttggacgatctctaagttcaaagcctcagccaactcattgaccttgacggtttctgtcataatagtccctctcttcatctccattgattcttcagctgcttctttttcgcaaactgttcctctctattttatcattctatcttaaaacttactacacgtgttattggaactacctatttctttttattttatgctattatttttaaagaggagggatttaattgaaattttcagactatacttacgtacgaccagattttgattcttacaaacacaattatttggaagcgttacacaaccttgaggaagcagccaaccttgaatctgcaaaaacagccatcgatgaattaaattatttgcggggaacgatcgacacggcagtcaacttggcttctattcgacactcaattgatacgacggatccgtattatgaagcagaagatacattttggaatgagtaccagcctcattttgaatcactggattttcgtttctaccgttgtctactcgcttcaccgctagtggaagaattaaaaactatctatccagaaacgttctttttatttgctgaaagtcgcgtgaagttatttgatgaatcactgatcgaattattccaaaaagagaatcaactgacttctgattatggcaaattgattgcttccgcccagctggagttccaaggagacagctatacccttgcacaactacgcccttttactgaacacaaaaatcgtgaaattcgtttggaagcaataaacattcaaacagcattttttgctgaaaatgaaacgaaattcgacacaatttatgatgaattgatcaaagtgcgtacagaaatcgcccataaattaggcttcgaaaattatgttgcttttgcagatgtccaaatgaaccgctgggattatgatcgcaaaatgatcgaaacctatcgaaaggaaattttagaaaaagttgtcccaatcactcaaaagctgtatgcccgccaagcaaaacgtaatcagctatcaaaagccacttttgcggatttgccattggtctatccgaacggaaatgcaacaccgaaaggcaccgcaaacgaattagtggagaaagcccgtaccatgtatcatgaactgtctcaagaaacaggtgaattctttgacttcatggttgatcatgagctcttggatcttttaagcaaaaaaggcaagcaatctgggggttactgtacctttatccaggaatatcaatctccttttatttttgcgaatttcaacgggactgctgctgatgtagatgtcttgactcatgaagctggtcatgcatttcaagcgtttcagtctcgttggatcaaagagccagaaattctttttccaaatttcgagtcttgtgagattcattccatgtcaatggaatttatcgcttggccttggatggatgctttttttgaagaggaaactgcaaagtacaagttcgcccatctggctagctgtctactatttctaccttacggcgtgttagttgatcacttccaacaagaagtctacgaaaatcctgattggactccagagcaacgaaaaacttgttggagagacctggaacgccgctattgtccagaacgtgactacagtgaatttcctgatttggatcgcgggctttactggtttagacaaggacatatttttgagtcacctttttattatatcgactatacgttagctcaagtttgtgcctttcaattttggtatcgttcgatcgtagcccaagatcctactgcttggcaagattatttggccatttgtcaagtcggcggtacacaaacatttcttgaaattctcgaaacagctcacttacgttcgccctttgaaaaaggtgcgttagatgatactctgaaggctgttgatgattacctagagaatgtttccgaagaacaactaaaatagaccacacaatccacggaacgaacgaatcatcattgatttgttcgttccatttttcattgcagtcctttaaataaacgacatgcagtcacgaactagtcaaccaggtacgttaaaagaatagtcagctctttttttgccagctgctaggactaacttactaaggaccaacaaaaaagcaacgaatactcgctgctttcttgcttggctattgagccaattttataagcttattcgttcgcttttttctttcttctaaagaagaaggtaacaacaagcccaatgaatgcaatccccactaatggataaacttgattgtcactcgaaccagtttttggcaaaactcgctgttgacgatctttagcagttgctttgatcagtttacttccatcatttgactttggatcaactggtttagtttgatcattgttgttagatttttttccatcgtcggttgctggttgtttttcgatcacttgaatcgtagccgttgccgtaacagtcaattgtttggttgtcccaaatatgcgctcaaacagcgctggatttgctactttctcatttgaaacaacagaatagttcacctgataagtaccgaccttcctggtatcaacagatccttcaataagaagtcgttcaattgatagggtattgccctcacgatcagttgctgagacaaaattgttcttagcctcccattgatcgcctacatacactactgagtccttaacaactacgcttgtttgatctgctaaaactgtgatcgtagctattgcttcaactttaccattgcggtagctgatttcatatttgccaggtgtcgtagtatcgacatcccctgttatatccaattcagctactgacaacgtttttccctctttatccgtcgcagagacaaagttatcttctgcctgccatgtgtctcctacgtagagcgtactatctttggctaccacggttgcttgatcagacacgacggtgatcgttgccactgactcggcgtttccatttttgtaggtcacttgataactacctgcttttgaagtatcaacatcgccgctaacagttacttctgaaaatgttacgttattgccttgtttgtccgtcgcagaaacaaagttgtcctcagcttgccatgtgtctcctacgtataatgtgctgtcttttgctttgacgcttgtttgatctgctaaaactgtgatcgtagctattgcttcaactttaccattgcggtagctgacttcatattttccgggtgtcgtagtgtctaccgtacctgtgacggttacattagcgagtgatactgcttttccgtctttatctgtgacggatacaaaattgtcttccgcctgccaagaatctcccacatagagcgtactatctttggctaccacggttgcttgatcagacacgacggtgatcgttgccactgccttagctgttccattggtataagtcacttgataactacctacttttgatgtatcaacatcgccgctaatggttacttttgaaaatgttacgttattgccttgtttgtccgtcgcagagacaaagttgtcctcggcttgccatgtgtctcctacgtataatgtgctgtcttttactgaaatactggataaatctttttctggtgtgattccaatagatatctggttacccgttcgattgacttttacatccataccagattgaatatcttctggaacaacatatccttcaggaacttttgaaacgtataccttgtatttacctgtataaatatctgtcaactgtgactcgcctacttgatcagtggtggtgttgatcacagttccagtcaactgattgattaacattaatgaaactccagcaatcttttttgtcggcctttctgtatcaaagacatcaagtaaagcagacgttttatagataatcccttccgaatcacctgctgaaaattgcagatttgcgatagtggatgtcgcggtgcgctttgcttcggacaatgtatcaatcgtctcggatgaaatggtggctgatgcagaaatttgaccagcgttttgagaaaggacggtatagctgatctccacgttctccttaagcacatagtttgcaaaaaccagctgaatctcaccattaactttctctactttataactatcatcaggaacatttgagattctgatggagtttggatcgatttctccattggtgttgccaatagattttaagctgaacgttggatttacaactttctttgttccatcatcaatgtttttcgttttcacagtgacttgggttacgttttttgcgctagtaactgtcctttgactaatatcgataatgtctgttgcggtattagagacagtgaccgtcgatgacccttgttgattaccatacagtggttctttagcaaatcccggtatcagaattgatttcgtttcctgccaaccatttgcataatgataggcaatgatgtatctgtgatcagttgtcccaaaatcgaacgtataataattcgtcgcttcatcatgcgtgatggtagggtaattcggatctgattctttcatgacttgcgtattgtattgcccccgagcccagtattgaggataaatcccttccacttgatcatttgagacatcgataatggaaaatacgacatctgtattcattggtacatgtgtttctaccttcagatctttgatggtatcttgccgggcattaactaaaaattgatttttgcttccttgcaacgtttgttctgaatagttttttcttccagtggtaactgttgtattgacagtatccaagccatccgctgagatactaatcggaattttatctactgggatccgcgttgtagaagcgagactgtctggcacataattaaatccaatgtcaaattgaattgaacgattgattggcgtaataaaagtaactaaggaccctccctcaaccttctcgatacggtaatcttgatcgatcttgtaataatagttcacttctggaacttttctaagtgtcaaataatctggatgttcgacgaagattttaagattttcgacaggttgtgttgtgcttccttcaacgttgactgaagtatcatttgcataggcaccattttggttgtagttcccccaagctgtctcagctgaattaggatataaaactgagattggttgtacataatcatccccaatcactttgaatttttcattgggaatcaaaggagtcgtgacattcatgacgatgtctttttgatcaaaaggaaccgtaagatgaatcatggaaaatgctaggttactgtctttggttgccgtcaaggtcaacatgccgttagaattttcgactttaaagtattcatctaaaggtacattttgataaaaagcatcattgaccattagttgcttcactgtaagttcctgtccattttcagcggatatcgttatctgctgtccttttttcatttcagttggcatgccatgtaatgttaaatagtaggatcccttttcattggaatataaatttccaccggcaacagctgtataataccttgatgaaatttctttttcagtttgacttgtttttgccacaaaagaaattccacggtactccccagccgatggttcaagatttactgatccaaaaccggtggttggatagtttttgtaataagaatactgatggtaactaatttcagatatgctcatcgtgaattgatagacaacaccataagccttttgctgatccatttgtttgatctcaactgctgtattttgtaagtcattagctgtaattgtataatctgtgccagcggctagctccgtttgcgtttctggcgtgatattccctttgatatctacatcatagctataaacctttagtggttgcgattctatttttttgaaaactgctcctggggtgtcaataagttgcaaagagagtgtttccgttcccgagagcttgcggtctaaattataatacactgtaccatctagaccaaaaatgtttttttgttgctcgtacttcaatgattcgacatcttcataaagatcgatcgcataactggttttatttagatcatcaattgtcactttgatttgcggggtactttctgaataaagataactctttaattcaagggaaaatgttgcatcgtggatagcttgattaaaagtgatcgttacttgacgattggcactgtctacttgccaagtcgcatcgatgccttgaatcgtcccttgattatcggtaaatccaagggtgtccggcaaactaaaaacaacagttgttccagctaagtaatcttcgtcaatgatttcaaaatccaattttagtttaactggtgtattatttagcactcttgtttcctgtgtttggctgtactcttcatcagccatcgtaagcagtgttcctttctttaaaagttcttgcgcctttatttgtcgattggaacgagaagcattttcttctttcttaactattttgggatcagtagaagatttgttggtttcagtttctgcaacactagaatcttttatacctgatgtttcctcactttgatccacttcgttctcttcactggaagaagtatcaacttcttcttgactactagcacttgaagtgaatgaggaagcttctttttcagatgaagccaagataggatctttttctttgtctattttactagttgtttcagctggctgatcagcctcagatgtttcagcaatcaccagtattggcgttgtgatctgagtaagactcaatgcaataacaaccatactttgttctatttttttagtgattttcttcattattctcctccaatttatatatgtatttttaatcaatcgcttttcttattttcttacccacttctaattcttcaccgctaaaaaaagaaagaatgttgtttgttcgatcaattttcctgatttgtcctgtattgataatgtaggatttaaacactttataataagcgggtaggtccaattgcttgatgactttcaaggacatctcaatgtattcgatcgacttcttttggtgaagaacgatttggttgcgctcttctttgaccgttgtgatatagttgattgattctgcatccataacgatcaattctcgtttgttttcaagctttaataagtgctttttgcctaataatgattgctttatttctattgcttcaattaataagtttcttagttggtgtttaaacgcttcttttgtatcaatgatccctaatgggcacaggaggttcatttttttcatctgtatctttgaagcatcaattccataaaaagctatttgacattttttacattggcttctcaatcttcctgctaattgaaaacctcgatcatatcctttcatatcagtggaaaataagaataaatcattgatatcggtaaggtgttcattaataaaacgctcaaattggtccggcaggaaaatttctactgaagcacacggaagttggcattcttggatcgctttttttagccactctccattaaaaaaattatcatctactacataaacagcaaagttgcttaaatttgcagacatctaagttctccttttttacatcatttttaattgtattattaatcaaaaatgcccgcttgcactttcaagcgcattaaaagaacctttgtgcaaaaattcagctgtatttaagaacaatataactattcacttagttagtagtagtggatattcagcaagaattgtttccgtagattttagaatggtactctagcgtgggcggcttaactgcttagactattcaatttagtgaatagctattagtcaaaaaagtggtgcgatgatactgctcgtattcccatcgatccccttcataaaatactacttctatcaatatttatcactgcgaaacaataacaaatgaaactaatagacacgagtattttcacagatttttctactcaatttaacatgacacagctagatgaacatgacaaaaaatggttatttcgaagaaataattggcggatttgtctttcttttataaaaaattacaaaaaaagatgttttgcttttcttattattacagtttgtttgttcacattgttctttaatattaaacaacaaaaacatccacacgttctttcaacatagctagctatgtatcagaaacgtgtggatgttttattttgtatatttttcgatatggtgttcagtcacaatcatattgatcactgacataatcaaagcaaccagaatcgctgcaccaaatgaggaaaagccaaagttagcagctcctacaaaagttgaagtcaaattcagcattaaagcattgatgacaaaactgaaaagcccaaatgtcaacagcgttaatggaaatgagatgatactcaagattggtttgatcaacgcatttaaaatagagagaacaaagctggctactaatgccatcatgatgctacgtacatggaccatgtttggcagcaatactgccagagcaacaaaggtgagtgtattcattatcagtcgttgaaagtaggacattagaagtcactccagtcctcatcctcgactttatctgcttctttgcgcggacgatttgtttctttgttgttcgctttgtagtactgattgtcgtgtccatatccaccagagcttttgcgtccagaagggatcaagatcgccatgatgacataaagggtgatcccagggaaaccagctgtcactaatgatagaaagacatagatcacacggatgatcgttggatcgattcctaagtattctgctaaacctcccagagtacctgtaatcactacattattggttgatttcgttaatcgtttgttcatttaccttcaccttccttctgacaatctatctatagatctgatggaatcagattattgttctgtgtctttgataaagacattcccagtcgttgttgaaagatcgacttgtgctactttatcagctacgcggcggaattgcaataattggttcatacgttcttttttctcacgcacgatttcaaaattgctcagccgttgattgatacttcctaagctggtttttgccaagccttcaaatccaactgattgtggtaatgctactttgacatttccgttgactgagctagcatttaatttttgtagtcggtcttctttgtaagtgattcggatattaccgttcactagagaaattccagtattttgtggtgtcgcggtaagagtaacatccccattgacagtttcaatgatagcatcaaggatatctccatcttgaaccaagatatttccattgacaccttcaatctccaacatcgtagcatctactttgcggaaatcgatcgtaccgttggttgatttcgtataaacatctcttgccaccaattcgtcaaatgttacattcccgttcaacaatttcactgcaacatgatcataggtacgtgtcggcagatagaaaaccagatcagcgcggatacgcttgtttggaatttggaatgaaatgcgttcatcgtcgacatcaatttggcttcgtgcatcaaaagcatcgaaaggtgttgcagcatccattttaccatagagtttgattttagcatccactttcacacccggttgatcccacaagcggaattcaacatttccgtttgctagtttcacatcgatcaatgttgcttctgtttcagcatattcaaaggtatgttcaaatttcgttgctgctactcctggaactttcagattgatatctttccattccatgttgtcattcactgattctgaaacagcacgaactgtttttttcaagaattgtccaaattgagtacctgcatcaaccattttttcactgacttgagtaaatgtatcagaggcttgttctttccagtcatctggaatatcaagtttttggctgattttttcttttgtttgtgaccattggtctttgcgaatatttttcaacttcgcatccaatgtcgctttttcttcgctcaaactatctaatgaatcttctagagaagcgattgtcgcttccgtctcttgccgtgttgcaagttcttcttcagataattgatccaattcctcttttgtgttcaattgcatgaggacttcttgtgcttctttcagttcctcttttacaccttgaatttctacattgatctcatctaattcagcagaagcttggtttgcctcagttgccaatccgtccaagattttttcaagattttctttatcttgtgcttcattttgacgaagtttttcttcaccatcaaaagaagcttcttctttctcgtgggcttcttcaacttcttcaaaaaagtcattatttgtcttatcagcggatacttcagctgcagctttgttgatttgattctcgtctttggcttttgccattccttccagcaaatccaatgcttcttctgtagaaagcacaccttttttcactaaatccaatacacgttctctttcgttcatggaaattgcctccttcagcaaatttttgtttgcaagtttagcttacgaacctattatgcctgtttttccgcaaactgtcataggtcttaagtaccaagtttttatcaatccgaagttctttcaataaaagagtaattgttctgcttgaaatcagagaagatgattctttgtgaaaggaaaacttgtgcttatcagctttatctaaaaaactacaaaaaaactgtactacagaagaaccgaatagcgcaagaataacctcacacgttttccaatagtttatccatgatcccagatcaatgatacgctatttttcatctctcttcttacagtacagtccgtacaataataatatacattcatgtgaaagctgatgagctaaatctatattttgaacaaagatatgctcactacatcagctcagaacgattactatttaactcactgatcttaccagtagccaaataaacgatccattcgcaaatatttgtgacataatcaccaatccgctcgagatattgggccacagaaagataatccgtaccactgacaactgtctcaggattggctttcatgctatcgatcgttttataatagatatctcgatagtaatcatttacccgctcatccatttgtgcaatcatccgggcatcttcttggtccgtttttacataagcgaccaaaacattgtccaccatttttttgacatagtcagacatatcggaaatttctttctcaatctctgcaattcgggtctcgcctttaacacgaatcgttgactttgcgatagataccgcgtgatctcccattcgttccaaatcggaactagctttcatcacagtgatgatcattcgcaaatcagtcgttacaggttgttgcaaggcaatcatttcgaaacttttcttctcaagtcgaacttccatattgttgattgcttcatcgttttctattacttcttgagcgatctctttatcatgcttcacataagcacgaacagatttatggatcgcactacttacaagcatccccatttcataaaattgattgtgaagattcagtaattcttcttcaaattgtgtacgcaacattgctttttcctcctaaccaaatcttcctgaaatatagtcttctgtttctttctccctcggactcaagaatactttcttggtatcattgaattcgatcaagttgccatctaagaagaaggctgttttgtcagagattcttgaagcttgagacatgttatgagtcacaatgatcattgtgtatcgttcttttagtgtcaaaagggtattttcgattttacctgatgaaataggatccaacgcactggttggttcatctaataaaatgatttccggatcgacagccaatactcgggcaatacaaacccgctgttgctggccgccagacaaagaaagcgcactttgatgaagcttatctttgacatcatcccatactgaggcagctttcaagctttcttccacggttttatcgagaatctctttgtctttgacaccctttaattttaacccataaataacgttttcgtaaatcgaaaagggaaatggattcggttgttggaaaaccataccgatttctttccgtaaatctactgtatcttgttgcggactgtagatgtcttttcctttatatacgacactccctgtgatcgtgacaccaggaatcaaatcattcatccgattcaacgaacgaagataagtcgacttgccgcagccggaaggaccgatcattgcagtaatttctcctttattgatggaaagatcgattccttttagtgcttctttttttccataatataaatgcagatcttttgatgtgataatttcttctgccatttcttagcctccgtttactgatcggatcagattagccaaagtgacctgatacataatcttctgttgcttggattttaggacgcgtgaatatttttcgtgtgtgatcatattcaattgcatttcccaagtaaaagaacgcggtatagtcactgatccgtgcagcttgctgcatgttgtgcgtcacgataataatcgaataatcttgctttaagttgaccaatgtttcttcaaccgttccggtagagattggatctagcgcactcgctggttcatccaaaagtaaaatatccggcttcatagcgatggcacgagcaatacacagacgttgttgttgccccccggacaatgctaaagcacttttatccaggctgtctttgacttgatcccacagagcggcttgtttcaaacttgtttcaacgatctcgtctaatttcttcttgttcttttcaccatgacgacgcaaagcaaatgcgatattgtcataaattgatttactgaaaggatttggacgttgaaaaaccatgccaatccgtttgcgcatttcatagacatcgacttctttcgtattgacatcgacacccttgtacataatttgacccgttactttcgtattcgcaataccatcgttcatgcgattcaatgaacgaagataggtcgatttcccacaaccagaaggtccaatcaatgcggtaattttgtttttttcaaattgcagatcgattcctttgatcgcttcattcgttccataccatacgtgcagatcatttgtataaagagcgacgtcttctggtcgatcaaaggtaatgatattgcgttcttcccaattataatcattcatacagtgattctccttatgctgacgtcattttcttatacaatcgtttaccgattgcacgagcgccaaagttaaacaatagaacagcgatgatcaggacagctgaagcgccagctgaaacttggattccatcaggcatcgttccttctgtattgattttccaaatatggacagccaatgtttccgcttgtcggaaaatgctgatcgggctggaaacactcagcgggttccaatttgaaaagtctaacgctggcgcactctgacctgcggtgtaaatcaatgctgcggcttccccgaaaatacgtcctgaacttaggatcacaccagtcaatatccctggtgttgcttcaggaacgatgattcgcatgactgtttcccagcgtgacaatccaagcgacaacccagcttcacgctgtgtatagtggatggcttgcaatgattcttctacatttcttgttagtaatggtaaattgaaaaacgttagtgctagggctcctgaaataatcgagaatccgtaaccgaattggataacgaagagtaaaaaaccaaaaagaccgactacaactgaaggcaacgaactaagaatctcaatcgatgttctcactacatctgtaaaccaattctttttcgcatattcggataaatagatcccggcacctaatgaaatcgggaaactaatgatcattgtaaccaataaaagatacaatgagttgaatagctgaatcccaatcccaccaccttcttgataagctttggaaggtgaggtcaaaaattcccaactgatatgaggaatccctcgtactaagatataaagcaataaagaagccaaaatcaaaacaatgattcctgctacagcataaagcacaccagtcgcaattttatctgagcgttttgcattcattatttcaacgctcctttcttaccaatcaatcgaatcacaatattgaacaataaagacattaataataagatcagcgctaatgaccatagcacgttattttcaacagtccccatgatcgtatttccgattcccatcgttagaatcgatgtcaatgttgaagcaggtgtcaccaagctagacggcatcaatgccgcattcccgatcaccatttggatggccaatgcttcaccaaatgcccgagccattccaaagacgactgctgttaaaatccctggaactgctgcccgcaaaacaactttgtaaatcgtttgccatcttgttgctccaagagcaagtgaggcttcgcgatagtgtcttgggactgctcgcaacgcatcgacagtcattgtcgtcacagttggcaagatcatgataaacagaacaaatgtccctgccagaatcccaaaaccagtaccgccaaaaacagaacggaccgctggaacaatcacggatagtccgataaatccgtaaacaacggatgggatccccactagtaactcgataactggctgcaaaatcttttcaccgttgcgaggggaaacttctaccataaagacagctgcaccaatcgcaaatggtgttgcgataatcgctgataagaaagttaccacaaatgagccgacgatcatcggcaatgcgccgacaagcggctgtccatctggaccaacagcactagggttccattgtgtaccaaacaagaaatcaaacacatttactttatcaacgaaaaacgtggcaagcccacgacttgctacaaaataaaaaattgagatcacaaccaaaacgatcaatgcgatacaaagaaaactaatgagctttccccgctgctccatttttgctcgcttagattttttcgttaacacttcttttacattttccacgagggattcctcctcaaaaatcaaactaaattcacaaatattagtttatcgctcgaacatcaatttctgttaaaccttttgtaaatttttcggcaacattgtaaattttgtgtaaaggttacttgatgacatttccttcccaatcacgttcaacttgcattcttgaaataggaatataaccaagatccccaacaatgtgctcttgaacttcatccgaaaggatatactctaggaattctgctgtcagtgctgtaggttctcccttcgtatacatgtgttcatacgcccagactttccagtcatttgtcgtcacattttcgtctgtcggtgctacgccatcaatagaaagaacattgacatcatccgtcacataagagaatgcaacgtaactgatagctcccggcgtatccgaaacaatcgaacggaccattccacttgaatcttgttcttgcgatgggattgctgtttctccatccatgatccatttttcgaaggttcctcttgttccgcttcctgccgcacggttcaatagaacgattttttgatcattcccccctacttctttccagttggtaatttcgcctagaaaaatctttcgtaaattttctgtagagatatcagatacaccgacatttttatttacaataggagtgattcctactacagctactttatgatccacaagtgctttagcatcgataccagacttttcttctgcaaacagatctgagttgccgatatctacagcacctgcttgaacttggctcaatcctgtaccactaccgccaccttgaacattaataaatctgcctgggttttcattttggaattcttctgccacagtctctactaacggctgtaatgcggatgagccgacagcggtgatcgattccccttgatcgatccattttgcacatcctgataatagaatgaccaagcctaaaactggtcccaaaaatttcaattttttcatgataacgctccttgttctctccaaagttaaatacaattatttccattttaccattttatggaattgttgaaaattattatttgctaatatttctcactcctgacaaaaatttactccatttcctacaatcacttacagaaaataactaaaagtaaaaaagtaaaaatttttttcaattagtaaaaagaagtatattgtcaattcttactgtgctatactggataagaaaacaattattaaaagaacataataacctttcttgcttccccaatcaagaatagccccaaattatgttcgacgttttcgtgatttcatcaacatttccccaaatgtatgttgaatcaaaacggcggcagaagtggtcatttatgtaccagcttctgccgtctttttttgtccaaaataacggattattgtgttttatccaggttatctaaccattgtgtgagtttctcagcgatctgttgttgttgttcctcatttgaaatcgaggcagctccgtcaccacgctgtgagccgtaactaccaaaaccagcgtgattgcctcctgagattgtttcgaaaatagctgaatccggcaaataggtttttgctgcttgataattcccttgattcaatacctcgtcattgctagcagtgagagaaagcacaggcaaattagtctctgctaaactgcctttttcatctggataactcgctaagaaaaagactccctttaacccattcttttgactagcggcataacggcttgcaatcacgccacccaatgaatgcccgccaatcacatagccactatgtggaaattcgtttaaaatattctctgctcgatttcccccaaggaccgccatatcaaagggcatcttgacgattgcaaccgagtatcctttttcagacacctcttttgcccaaatactgtaactttctgcatctactagtgctcccggataaaaaacaacgagtggtttttcagggtctccagagaaataaagcgcatctcgtttctcttgcccttttgaaagagctgcttgagcggcttcacttgccggatagtgtaatttttgccagcccaaccatccacctgcaccgatcagcagtaggccgatcactagaccaagtagtattttttgatattttttcattttccatcctccaaaatcaacaaaatggaaccgcctgaaccaagcagtcgcttcttaactagtttgaagggagcggcacttgcgttcgcgtttccattttgtgggtaacttctttcaagtatttactgatgagccaaggctaacaattcacgcgcatgctctactgtcagttctgtgatttctgctcctgataacatacgagcaatctcagtcactcgttcttcataggataactgacgaactcgagtctccgtccgtccttcttggatcgctttttcaataaaatattgataatcagctactgcggctacttgcggcaaatgagtgatacacaatacttgggaattcaacgcaatttttgagatcttttcagcaattgcttgcgccacgcggccactgactccggtatctacttcgtcaaaaacaatactcgtgatcccttgtttccgtgaaaaaatcgatttcaatgctaataagatacgagacagctcacccccagatgctacccgaaccaacggcttcatgccttccccaggattggtcgtgagataaaaagccacactatcaaatccagtagctgtcaactgcttgccatttgcaaagcgaacttcaaactgtgcatgttccatatagaggtcgttcaattcttgcacaatttctttttctaatcgatgtgcgatttctcgccgcttgacatggagttgttcagcaagagcccaaacagcatcggccttagctgtcaattgctcttctaactgttccagctggccttcagtataggcagattcagagatctccttactaatttcttcataataagctaggatgacggagatggactcgccgtatttgcgcttcaattgacgaatcgtttccagtcggttgataacttcttctagacgtccttcatcaagttcaaggttatctaattgtcgtgaaatatcagaagcagcatcctgcaacaaataataagcgctctggatcgtttcagtgattttttcataggcttgatctaagtgggcgatagattggatctcggacagtgccacactcacaccgtcgacactgctcatttcttctgaagagagcgcaccataactttgccccagtgcatcgacgattttctgatagttggttaacttctcacgttcttcgatcagattttcttcttcgccctcgattaattcagcctgtgcgatttcttcttgttggaatcgcagcatatccatccgttgaacatataattgttcattttcctgaatattgcgaacctgtttttctaaattgcggtattcctgataggcatcctgatagtgcagcagttcttctttgaaaccatcatcgccaaacccatctaccaagctaagatgcctttccggctgtaataactcttgatgttcgttttgtccttgaatatcaactaaaaaaagaccaatctttcgcagatttgccaaggtgaccgtacgtccattgacacgacagattgtttttcctgcttgtgtgatatcccgttggacgatcagcacatcttcttgatcaatgcctaattcttctgtcagttcttgaaactcagactgctgcggccattcaaaaaggccttccagtcggcatttctctgctccttgacgcaagtagtcagtagatccgcgtccgccggctaacaagcccatcgcatcaataatgattgatttcccggcacctgtttcacctgtcaaagctgtcattccttcatgaaaagaaaggtgtaagtgggaaataattgcgaaattttgaatggtcaactctaaaagcatggattgcctcctctacataaatcgttgaaaatctttaaacaaagtttctgcatctgcttctgttttagtgatcatcaatacattgtcatcatcatttaaggtaccaaacagttcctttgcatattgtttatcgatcaaatttgccaaagcggaagcatttcccggcaatgtgcgtaaaataacgaatttatccattcgatcaacagaaacaaaggcagctttcaaaatcttttctaatttggcaatgacatcttctgacgtttcttgaggaatgctgtagcggtagccacctttttgtgaagggactttgactagcttcatttctttgatatcgcgggaaattgtcgcttgtgtgaccgacacccctttttcctgaagcaattcgacaaattcttcctgtttttgaatatcttgctcactaagcaatcgtgttatcaaacgatgacgctctttttttctcatctctcgttcctcctgattgaattcctactaattttatcctatttttagacagaaagaaagagagccggcatgtaaaataccagctctgcaaaatcagtaagtttttggatgatgaaaggtttcatgtgcttcagcaacgatctgagggacagagatttcggctttccttgtgccatcaccattctgcactttctgtagatgaaccaaaaattcaatgttgccttcaccgcccgtgatcggtgaaaaactaagatcaagaatattaaagccattcgattgggcaaagtccaagatttcttcgagaaccctttgatggactgcaggatcacgaacaatgccgttttttccgacagatgctttccctgcttcgaattggggcttgatcagcgctatgacttctccttggtctacgagaatttcatgtaacggcggcaagatcaacttcaaagagataaatgacacatcgatggttgctctttctggtaatccttctaaaaaatcagtaggtttggcataacgaaaattcacacgttccatcacgactactcgcggatcttgacgtagtttccacgccaactgattgtagccaacgtctaaggcataactcatttttgccccattctgcagagctgcatcagtaaagccgccggtagacgcaccaatatccagcagaatttggtctttcacctcaaagtcaaaaattttcaaagctttttcaagttttaagccaccacgggagacataaggtagctttttgcctttgatttgcaactgtgtctccccgctgattttttcacctggtttgtctaaacgttcatttttctctgtgtaaactaatccagccatgacaccgcgcttcgcttgttctctggtttcaaaaagtccttgttggaccgctaaaacatctactcgttcttttttcattactttcctctaatctcgaattgtttgacaacggatgtgatcaatcgttgatcgaaatgtccataactgctcagttcatctaacacagcatacgcttgattcaattcatccttcaacgcttcactagcgccatcaagtcctagcaaagccggataagtacttttagctagtgcatcatctcgatggacaatcttgcccaatacttctgttgtactggtgacatctaaaagatcatcgcggatttggaaggctaagcccatatgacgagcaaattgatcgagcagctggataacttcttctgtctgatccgctaaaataccacctgcaatcactgcaaaacgaatcagttcacctgttttgcgttcgtgaatgctgatcagctcatcaagtgtgagttgctgattttccccttggatatctgctgcctgtccagccaccattcccgctgtgcctgccgtatgactaagctgctgcaaaagcaaaattttcttatctggttcaagatcagctaacgataacaactgaaacgcagcagtcaatagaccgtccccagcaaggattgctagtgcttctccatagactttatggtttgttggtttgcctcgtcgcaaggcgtcatcgtccatcgccggcaaatcatcatgaatcagtgaataggtatgaatcatctctagggctgctgcagtctggtatactcccaaagtcattgacttatggaaagaagcaacggtcgctgtcaacagcagtggacgaattcgtttaccgccagcatgaatggagtagagcatactatctttcaacgtttgatcacttgtatgctcttctagaaatcgaacaatcacagcttcgatctccgaaagatatttttcttgaaattgttgcatgttatccattagtcttcctcatcaaaaagaacttcttcattgttttcagtcatcatttttgttaatgatttttctgctttagccaatgtatctttgcactgtttgcttaataccattcccttttgaaaagcgtcaagagcttcttctaatggtacatcgccttgttccagctgagtaacgatttgttctaattcttgtaatgattcttcaaatgttggatttgccatgatcttctccttctgttgcaataactttaacaagcgcttgaccatcttgataatggacgttcaactcatcaccagcttcaatatctgcgatggttttaacgacttgctcgtctttcgtcgtaaaactgtagcctcgtcccatgatttttagagggctcaaaagatctaacgattggagagcacttaaaaatcgctgttcttttttttcaacgctaagttgaatggctttttctagtcgttgcgttaaataagtaacttcttgtcctgcagctgatagccgtgccttaggtagctgttgttccaaacgatgaatcaactgactggccaccttctctttatcatagagctgtgtttgcaacgattgattcattcgttgctgcaactgatccagcttaatcgcttgggcctcatataagcgctctggttgacgaaaaatataagaacctactgcccgttggaaacgttcttgtttccgctggatttgatacataaatgcttgttcaagccttgtttgcttctcttcgatccgtaaaatttcttctgaaagaactggcactgctaattcagcagcagcagttggtgtggctgctcgtacatcagccactaaatcagcgatggtggtatctgtctcatgtcccacagaagaaatgactggtgtctcggcagcgaatatggcacgtgcaacgcgttcttcattaaatggccagagatcttcgatagaacctccgccgcggccaataatcattgtatcgaaggtgccatctgcttctactcgttggatattttttactacatcatctgctgccttgtctccttggactacggttggaaacaagacgatttcggcaatcggatagcgccgctgcgcagtggtgataatatcccgaatcactgcgccactggggcttgtaagtaccgcgattcgttttggaaatcgtggaaggatttttttgggagctgaaaatagcccttcttctgctaattttttcttaagttgttcgtaggcttgatacaacgcccccactccgtcaggttccatgtgttcaatgtacatctgataatttccgctggcctcatagagtgaaatgcggccaacagccaacactttcattccttcttccggctgaaatcgcagcttgtcaaaagctcccttgaacatgactgtcgaaatttttgcgccatcgtcttttaagctaaaatattgatggtttggccgtctgcgaaaattggagatttctccagtcaaatagacccgttccaagtaaggatcagcatcaaacttgcgtttcaagtatttggtcaatgcggtcacagttaaatattgttgtgccatgttatctctttacagtctcctttgccgctgctaaggtttgtgccatcagcatcgtgatcgtcattggtccgacgcctcgtggaactggcgtgatatagcttgcgataggttcaacttcagcaaatttcacatccccaatcaattttcctgcctcatcacgattcattcctacatcaataacgactgctccttctttcacaaattctttagttacaaaatgaccgcgtccaatcgcaaccactaagatatcggcttgtctagccaatgctggtaaattctgtgtttttgaatgtgcgatcgtgacggtagcatttttaccgagaagcaaatgtgccatcggtttgcctacgatattgcttcggccgatcactaatgcatttttaccttcaagtggaatatcatacgcttcaaacattttcataataccgtaaggggtgcaagggattcgatcgggaacaccagcaaacaatttaccaaggttgataggatggaaaccatcgacatctttttcaggtcggatagctagcaacactttctcttcatcgatttgttttggcagtggcagctggactaagataccatgaaagtctgggtcctgattgtacttgtcgatttcactaagtagttcttcttcagttatcgactcgggataatgttcaactttagatcgtatgccgattcttgccgcagccagttctttgtttcgcacatacgtttgacttgctttatcttcccctaccagtagaacaactaagccgggaacaattccttgttcttttaaaagggcggtttctgcagtaagatctgcttgcattttttctgctaattcttttccattaatcaaaatacccatcttgacaactcctctgacttttttctattctagcatagttcgctttgaagaaaaatgatttctggtaggaaaatcatcgtttcccatctctagtatcatagcattttctcattgcaactgcttaaccaaagactcacacagaacaataaaggcagcctcttttgcaaaaggactgcctagttttcactatttatttgtagaaacctaatcaattcaaaacccgcagttttgatataatgagtctgattgatcagctattcttcactcatttttcacaaggtttctgagagtcatcggtgccgcaaaagtgtgatagtttaatcctgagattgaaggattttgtaacactgagttttgattttggctgataacgatcataccggcagttgtttccatcagttctttttcggctgcaatcatcgtttcccatcgcttgttctcatcaagagcataggtagtgctggcatcatccaataagcggtcataaaaaggattcgagtaatggcgattgtttccgctatacatcatcttaagtgtagaataaggatcttggtaatcgggagtccaataaattaggaacaaatcatagtcgctttcactagcaagattcaacgctgtttcggctggcagcgagcgcatattgaccttcaaaccagtaaagaggtcctccaaactccattggatactctcacccatttttttgtaggaaccatcatcagtcgttaacagatcaagctcgatttcatcgcctaattctgcttttgcctgttcccaataggctagcgctttttctttatcataggccatcaaatcaccggcttcctcacgaaagtccacgccagtatcaggattagcgacaaagccttctgtgatcgcgccattcaagggtttggatccatctgccataatattattgacaagattctctttatcaatggccaatgcgagagcttttcgtaaattttcattttgtaaaggtgtcggttgtccctttctttcttgatttaaccggatataattcatcgttgccgaaggataagaggcaaattggtcacttgactgcatttgtttggcgatctctccactgatgattgcgacatccaactgtccatcttcataaagatttagcgcggttgcagattcttttaccacatcataatggatctcttctgccagaatagcttcttgatcccaataagattcattcttggctaaatcccaattcatctcagtttgctgccagttttttacaacaaatggtccattataaacaattttgtcgctggctgtcccatattcctgtccaaatttttcgacaaccgattgattttgaggaaagaaaatcggaaaaaccatcaaggaagtaaaatacggagctggttgtgtaagacggacttctaatgtatagtcatcctttgcttcaacacctagcgtatccaccgactgatcaccacgggcaatttcttccgcattttcgatcaatccattcatcaagaaactatactgaaatgcattttcaggatcaatcatccgtttccaagcatattcaaagtcattcgctgtcaccggatccccattgctccattgtgcattttcgcgtaacctaaagcgataagttttgccgtcagacgaaatttccggtaaatcaactgctacacccggctgcacttcatccttttcatccaatagatataagccttcaaaagtggctgtttgaataattgcatctgggaagtccaacatggcagccggatccaatgaagttagctctgtcatagacattagtcgaatcacttgagaggctgaatcttctttctgctttgttgttgtacctgctgtacatccagtcaaaaatatcattgctactatcaaccccaacaatctgttaaatccttttctcattcttttcctccttttttatcgttccaccaaaaaccacacagcctcagccgtttctgtgccatcattgtagttgatatgcccttctccggcttcgatccattgacagtctcccggatttccagtgagatctgttccgtcttctaaaactatatgagcgcttcctttgatcacataggaaaattcatcttgtgtgtgacgtgcaaatccctctaatggtcttttctcacctggagctaaccgaaccactcccatttgaacctttccgttggtttgattcaatgaatcaaatatcgtttcaaattctttcccattatccgctgaaataattttcattttttctgactcctttcaattattactttcaattaaatcgtcagaatattctaaagtcaatacttttattcaaaatatcgcttttatttttatttttcagctgtttttttgaaaaaattacttttattaacacttctctctgtagaaagatccagtttttcacctcaaccaacttaataacaactatggcattgtatcgcaaataaccaaaaaacagcctcagcttttagctgaggctgttttgattaactagtcattcttactttcaatttcactgttgacattagacaaaataccattcacaaattttcttgattggtcatcactgaatgttttggctaattcaatggcttcatttaacgcgactcgattaggaacattgtcaacatacaccatttcatataatgcaattcgtaaaatcgttacatccatttttgataatcgttggatcttccaaccggattttaaatgggactggatcacttcatccaacgcttctttgtactgacatacccctgctacaagttgatccaaatacgctggaacgaagtgttcctgttcttcatcaatcagctcatggtgttccaactcaattgcatgcatgatcgcatcttgtttcgttaaatctttattaaaatctaaaggaaataaggcttgcagagccattttccgaatctcgtgacgtgataattctttactcattttcttcctcgtcgtttccgaataattcttcaatatcaggttgctcaatcttttctggtactacagctaccacatggacattgacttccgctaagtgaacatctgtcatgaacaatacttgctgtttcactcgatcttgaatttccattgctactttaggcacagaaacgccatagcttagatagcaataaagatcaaccttgatcccagtttcatcgattgtcaagtagacccctttgccatgcgcggagcgtccaagcaattcagtcacactattggctaatgtcccccgcatcccatagacaccttccactttagatgctgcgataccaataatgatctcgatgacttctggtgcgatcacaatttcgcctaattcaggacttgcgtctaagactagatttttatcttcattcataagttttgcctccattctaaacttccacacattgttatctatcccttcacgatatgtttcgtctcaataagtcatgacttggatagacagtttcatttgtatagaggtttcttctcgccctaagtttatcattttctgcactgagaatctataataacccactattctcaatgaattttctgaaataaacgaggatgttgatttacaagatgatcaattctttaggagaatgcgtcaaaacttgattaccagtttctgtgatcaacaaatcatcttcgattcgaacgccgccgatacctggaagataaattcccggttcgtctgtaatgacgttgcccgtaacaaatgctttgtctgctcggaaagagacgtttggtccttcatggatctctagaccgattccgtgacccgttgaatgtccgaaagcttctccatagccgaatgaagcaatatgatcacgtgcgattgcatctaattcaattcctgtcatgcccggtttggctgcagctaaaactttttcttgagcttcaaggacgattcggtaaatttcttttaatttgtctccgggatcacctacggcgaacgtccgagtcatatcagaaacatatccttgatagtagcaaccaaaatccagagtgatcaaatctccttgttcaattactttttcactagctaccccatggggcatagctgaacgtaatccactggcaacgattgtatcaaaagaaacgcttgtagcgcccaaagaacgcatgaaaaagtcaagttgattggctacttctatttctgacattccgggacggatcattttcaaaatatgttcaaatccttgatccgcaatatggcaagcttgttggatcaacgcgatttctgactcatctttgacttcccgcaatgcttcgatcatacctgaaacaggagccaatgaagattcttcaataatctcctccaagaccgaataatcagaaaagctgacgtaactttcttcgaaagccaaaacattgatctcttctttttcgcaaatagccgcaacttcttcaaaaatcggtccgctattttttacgatttcaaatccttgtgcttgagcagccgcttgctctgtataacgaaaatcagtaacgaaaaaagctttttccaatgtaatgacagctaaaccagtcgtgccggtaaaattagtcaaataacgcaaattgtatgggctcgtgatcaaaaaaccatcaacggcatcttttctcattgcttctcttaatttttcaactcttaacattctttctccccactttcttgttctgtattattatagcaaacttcccagaaaagcgaaaagaatgaaaaaaatttatacaaaaaaagacagattgcttttagacattctttaatcctcgttaatctggtctatcaaagaaaacaaattcgtctccatcacacgcgccgttaaaatgttttcaccgctttcaagaagggtaatcagtgcatctacggacatgcgtgctgaaattccataggtttgtacaccgtttttttgaatgtaggtcaacgctgtttcaatttgttcaacagatagaatatcacgcgcgtcattcgattccaaggctaaaaagtctttctgggttagtaagtatttcaacatcgattcaaaatgcgcagcggattgttctgtttctgaatagtctgattgttgtttgctagttgcttctgataaatccagaaaaggaaagtcttttaaaaaactctcttcaagtgtcttttcttctgggactacacgagaaaaactattggaaaacccaagcggctgaaaatcttgatttccagttgccccccctgttcgaacagctgtccagagaatttctcctttgggtatttgatacatctgccagtctctcaattcttccaaagataagtctttctcaaaaattaatgtggtgatcaatgaagtgcttttgggcaatttttttaaattgttcaaaaggttctgcttcattgtctgattctcagagaattcaagactcgatgaatctcgcatacgtgattcaaaaagaaaatcttttttttgcgaattagagagataattcttcagcaagtgatttttatcgatcgttactgtctgaatcgtagaatgattctgatcgagattttgataaacttctgtcacctcataactgccaaaacctaatgaacgtatttcatacttcgatagaaaatgattttgcgtcgttaactcgttattgatttgacgattcatgatgtaactatcttgatttacttgtagactactttgccgaggatcatagaaaaagaggtcaacaaattttggcattacaagtaaaactgcaattgtcagtacaacagctgcaaaaagaaagaaaatccctcgtttgtaacgttgttgtttgattttcctttgcaattgttcaaagtgaaatggttcattcatttgttaattcctccttaagtaattgtcttcctcgatacaaacgattcttcgcttgcgtgtagctccattctttatacgttgcaatttcctcaattcgccactccaaaaaatagtatagtaaaatcacttctcgcgtatctttaggtaatttctcaatactgcgatacaatgctctttttctctcttgtcctattatttcttccaatggggtagacaactgttggctttctgcttgaaaaacgtgtgaaggaaactttcgccatcgatgtgccaccgtttgtttacgcgtccagtcaatgaagcgatttttgattatttttagtaaaaaatagttgatttgcttttcgtttagctcatcgagagattccgctatgacgagaaacgcctcactgactaaatcttgggcctgctctttattttttgtaaaataaaacgcatacaaataacagtcttgcgagtaatctttatatatttttgctaacagttcatctcccaactcagtcacccctccatacctactatacgaactcacagagaaaaagtcacaaaaaaaaagccattcattaaaaaatgaatggctgtaagttattttctacgtcccaagaagaacgaaacaacagcgacaaaaatgaccgctccgataatggcaggaacaattgccattccagcaatctgtggtccccatgttccaaatagtgcttgaccaatcgatgccccaactagcccggctacgatatcaaagatacaaccgcgtttctcaccagcgattgcgcctccgattgatccgatgaccgcacctacgatcaatgtccataaaaaatgcataatacccctcctaaactttctaataaaagggtaccacatcaattatggtttgaacaagaatatgcctgcatgttattttctgcgagtgaacgcccgctttagcacatcgaaaaagccaagagaatgaaccatatgatccggatcaacatagacgcgaatcgcccgcaaaactttcttgggctctttcgaagaaaaagtataggtgccattttttttcgtccgaatagcgtaccttgggatccaacgacctttgaacatgacagaggcaatcacgtaatctacatcttcccaaggaatctggataaacttccgctggtcacggtcgttgtaaaattcaaaagccttgtcgccgatcataattttgccatattcgttgatacccaaaaatgaggtcgcatcgatcgtcaaatcaactttggtgttcagggattgtaccataatttgtttgctccatttctacgtcttattgtttcttattatacttgttctgatgatttttggcgaatagataaaaagtgcttgggtttccccaagcacttttagttgaaagattagaacaatccgatcaagtgtccaccgataccgactaagaacaaaccgataatgatgatgattggagaaacttttttcttcaataaccacatacataacagagtaagtaatagtgcagccaacccaggaatcaattgatccaagttgttttgcaaggttgttactttcgtatctgttaatgcacggccttcagcgacttgttggaatgcttgttgtaacccttctggacctgatggcaattttgcccaatccacatatgctccttcatcaagagggacacgagatacaactggtgcaaatgaaattgatacccaacgttgaacaagcgatcctaatacgaacatccctaggattgaagcaccttttgttacgtcttgcagcaaaccacctgaaaggtcatctgtgatttttgatccggcacggtagccaaattcttgtgtataccacataaatgcccaacgaatgatattccaagccaagaagaagatgattgggcctaagatgtttcctcctaacgctagagaagcacctagagctcctaacatcggacgaacagtaaaccagaatacagggtcaccgacaccagccaaaggacccatcataccaacttttaccccttggatcgctacatcatcgacagcggctccattggcacgttcttcttccaatgctaaagttacccctagaattggtgaagcaatatatgggtgagtgttaaagaattccaaatgacgcttcaaagcagcggcacggtcttcttttgttttgtataattttttgattgctggaatcattgagaatgcccaaccaccattttgcatacgttcatagttccatgaaccttgaatgaaggtagagcgccatgctacggctaaacgatcttttttacttaattgaattttttctgccatttttttctcctccttcgattctaatagtcattcaagatatcgcctagagggtcgccagtgttgctgccgccgcctccatttgatgatccgcccattttggtgatgttcaagtaaatcaatgcaatagctactgccaatgcaccgatcgcaatcaatgtcaattcagaaatcgctgcaatcacaaaaccaatgatgaagaatggccatacttcacgagttgccatcatgttgataaccattgcgtaacctacggcaacaaccataccaccaccgatagccataccatctgttaaccaagctggcatagattctaggaagttttgaacagttgcagctggaattgctagcaatgctgctgctggaatcgcaatacggatcccttgcatacatacggcaatcacatgccacatttcgattttgcggatattaccttcttcagcagctgcatccataaagtgaacgattggtacagctaatgtacgtacgatcattgttaagaacaaaccagctacagccaaaggaatcgcaacggcaatggctgtgtcaacaccgccacgtccttgtccacctaaaactaaaataattgcagatgcaacagatgccaatgcagcatccggtgcgacagcggcaccaatgtttgcccaacctaacgcgatcatttgtaatgatccacctaaaataatacatgcttctaagttaccggtcactagaccgatcaatgtacatgccactagcggttgatggaattggaattcatccaagatcccttccataccagctaaaaaggcaacgactactactaataccatagatataatagacatgatagacctcctatttagttgtatactttttacttgttcgacaattcgtttttcgctttacgcaaaatttcatccatgttgtcgcgtgaatcgtttggtactttacgcacatcaaatttgatgccccgtgattttagttcttcgaacgtttcaacgtcttcagtacccatagacaatactttacttacaacaacttttccgactgagtgagccattgaaccaacgttgacttcttgaatgtctacgccgccttctactactcgcaatacatcttctggattttcaaacaatagcaatgctttcgtattaccaaaacgagggtcttttgacacttcgatcattttttctactggaataacattggcttttactcctggaggagctgcttgttcgatcaattttttacgcaagtcgtcttttgcaactgcatctgatactacgatgatccgtgatggattcactgattttgtccatgctgtagctacttgtccgtgaagcaaacgagagtcaacacgagccaatacaattttgatcttgccatcgcccagtacagtacctggaggaagtgatcctttaggttgatcgtcagccacaactggagcagcagcttctgccggttcaagttcttctggtttcaccttgaccccttctttagctgtttcaatgatatgtgcagcaatctcatgtgctgtattcattgaaaaacgtgaagcgtaagcctcgatgaccattggtaaattcataccagctacgattgcccatttgtctttgtggtcttcaaacaagctgtttgcttggttgaaaggtgtaccgccccaaagatcaactaagaataacacttcttcttgatcgtcgaatgtggcgattgcttcttgcatttttgctttgatatcatctgggccttcacttggcatcaatgttacagctttaacattttcttgttcgccgaaaatcattgaaccagattgcaaaatgccgtttgcaaattctccatgacttgctaggataattcctaccatctttttacctcctatttcaaaattgataaatgtgacacttaaatgaaagaaaaaaagcaacgacgaaaaatcaagtgtgactaccctctttttccaaaatatccatcaaatagattttacgatcagcaggaacttttcgaatctcgacttcaatgccctgtttctgcaaataaagcagtgattcgaggtcttgatcattgacagaaacaaaattagtgatcatccgctttcctatcgaaaagctcattcctccaatattgattgaatgaatcggtaatccgcctttgactagtgtgacaacatcttgaggattggtaaataataacatgactttttgggtatcaaataatgcgttatgtgcaacctcaagcattttcgccactgtgacgacattggatttgattcctggcggagcggcttctttcaaaagaaatttgcgaagctgatcatttgcgacttcgtcactgacaacgatgattcggttaataccagtcattttcgaccaggctgttgctacttgaccatgaatcaaacgatcatcgattcgagcaagacgtatatccattcccatcgtaaaaacctcctacatccatcgatccgctggctatttgtggatcccttacttttttcattcacctcctgtatccacttatatagaagcaagaagcgtgccaacttttatacaatacactaatctttggaaaggcttaagaatcggcctcttgatgatacactaaaaaagatacactgaaaaaaagtgtatcttttttagtgtattctattcttaatgtattattgatcagccaaaaccgttttttcttgatgatttttaatcaactctgctaagtaatattcttcgctttctggtatttctacatttaacaagcgcgagaacgagcgaacatggatgtgaagttttttgtacatcggctcttgcttcagttcagaaacaaggggttcatcgacagttaaaggttgctttaatacgatccgttcgatcattccagcagagtggagcacaaaattgatttgaaaccctggtattgcatccgtcaattctaaatcattgatcaattgatggccaaattgccacaatggctcgataacttttcgcggattgacaaaagtcaggttttgctccatatatttaaaacaaatttcttctgcttgttcttcaccaagttcaacgtcttgttcaaaactcagatcattctctaacaaaatttcttccaacaattgatctacatcttgatcaatgaatcgttccagagaaataaaaggcgcatcgatttttggatctatgatccctgtcgtggcgatcagttgatattgtctttgtatgggttctaactcagtctttaaatcagccactgaaagtgtcacaacctctacattctgattttgacgtttcgagagggaactttgaattagttctttgatcctctgagccgttcctttacccgaggcacagatggctaagatggctttgcgatgatgattgcttaagtgaccctccggctgttcaacggaaccatagccgcgaaattttctaagcgattcatacaaactatcgatgtccgtgccgataactgaggcttttcggactgtttccaaaacgattgatgtcgtcaccatatcgacagtccgtacaatcacacctgtttccctctgaatctcattgttgaaggtagctaaagatcccatatctactaataaaatcacgccgctaccatcattaactgcttgaacactttcttcgatctttttcaatgcaacggtaggcggcatgtccaaaggcatgtctactgctgccacttgatccacttctaaaagttgttgaaccacttgaaccatactgcttgccgtgctgttcccatgggctgctacaactacaccaatttttccagaggaatgggcagtccgcaaagatacgagtaaaacagccaaataataggtttcactttcaggaatcgatactttgaaactatcaccaataaatgtacgaatttctttagcaacttcaaactctttcggatagtcggcgaccatttgacgaatattgtcattggtatgccgttcttctcccagatgaatttttttcaaaaaagaactaatgtgtaagctcatcgcatacacaaaattttgctgaaattcatagttcagccttgtgcgtaccagatcataaatacgatttgtcactgtgatcactttttgatccacaaactcgctcaatttgttttctgaattgaaagaaaagccgtgatctttgtaaaatgatttcaaatgaacattgatatctgtagatatgaaatgattgatggcttcttgatccagcccatccgcttttaataaagcagctttatcgccgataatatcgtaaagattatacggtaattcataagaatcggattgaatattattaagattttggtttggttgaacacgcacagtcggctcaagaattttggacagctctgctaactcatctcggcgattccccaagaccattaatcctgagcggattccttcgggaagttcgtccaaatcaatctcgatttcatcttgttgcatatgattcaagaaccctcgtgcacagaccaactgaacgttggacttcaattgaccaatatttccgaagctgacactgccaatcaacgctttaacgacatcttcagtcaatgtgatcgtgcgttggattcgtgttgcttcttgtcctacaagtacccgaacaagatccactttttctgaggcaggtcgtttttcaaaaaacggcagttggatattgatcggaattctccgagtaaaagtgtccaacaatgtcgaattgggatcctcagtagttgctccgacgatgcgaacattggcttgatgatttttaccagtctcacctaatcgactaaaggttccatgatccataaagtaaaaaatcatttcttgtccttcaggcggcaatcgatgtatttcatctagaaatagcatactttcatccgcctgatcaatgattccggttttctcctgatccgctccggtaaaagcaccgcgaacataaccgaacaaatggctcataagcaactctggattattggcataatcggcacagttgaaaacgatcaactctttttcctcttcgatcacctgattgcttttcgcaaactgaaacatggcgtgagcaaaatacgtcttccctgaacctgttggtccagtgatcaaacaatttagccccttaggaggatacagaattgccgctttggcttgttcgacagcatttttcatgctgccgttcacaccaatgatcgttgaaaaaatatcacggtttcccaatttgacatccactcgctgcggcgtagctttctctctttgggggcggttctctttataacttggaacatatttctcaggcccagaccgtgcatcttgagctacccaatacctcactggccgggtatcactcttttgaacgcggccttctttgacaagttgattcaaatctttgctggcattgcttcgttggatcatcaattgatcagcgacctctgatgtcgtcgttcccttttcattcaagccattttctgtattttccaataaaaattgataaatacgctcaatccgtttccccaacagctccgcctccttgaaagttttatccttgaatactttaatgggtttgaataaaaattgcaaatcttttctgaatactttccctactcaaaccagccaataacctagccacccttaaacacgccccttgaaaaatcttgcagcatacagcactaaccattttttcatagcaccttttgattaacttaagaataaagcatttagcaaaaaaaagacaatctaatgctatgattattgtgtcaatgggtagggaataaattttggcacgtcaccaacaaactgctgcaactctttttgcatccataaaacatcgtgccactgctcaaacttatagccaatttgtgggaaatatgcaacttctttgtaaccaaatttttgatggaacctcacactgctttcattcccagccgtgatacaagcggtcaaatttacgatattttgttttttcaactctgactccaaatgatgataaagcatcgttcctatcccttttgcttttacttctcgatcgatgtaaaccgtcacttccgccgtccagtcataggcagctcgtgttttgtaagcggtggcataagcatagccaagaatgacaccattttcttcagcaatcaagtatggataatgctgaagcgtttgagtgatccggtgcgcaaactcttcctcagttggtatctctgtttcaaaagtaatagccgtatgatctacataaggcgcataaatttttaacaatgatttggtatctgcaacagcagcctttcgaatgttcatatattcccttctttcttcaaatttttatcagtatacctttctaataaaaaaaagacaatccttgtctaaaaacaaggatcatctttacccactagcttacgcttgatttttttcttgcccgcaaaacacagtaatatgttgtggtaatacttggatctcaaccggcagacttggaccagggtctccatcgacattggtttcgatcgttgtatcatccagtagtttgatctgcgctttctcaaacgttagatatccaagggattcgttggattccgttactccttttagcagttcgggaatactcttgatggtttcccaaagattgctgtctttaatgtagataagatgcaatttcccatcattcgtactcgcttctggtaacagcgattcaaaaccaccgatcgtattcgacgatcctacgatcagtgtgctgctttcaattttggtttctgttgcttcctgaccactagtgataatttcaaattgatgactttcatttttgcgtacttcccgcaacccggaaaggaaataagccatttttccaagtttcgttttttcttcaacttcaacattgttgatagctgctggaatgatgccgatcgccactacattcatgaaataatcgtcattgattttcccaatgtcgattttgcgagaatgattcaacgaaaatgattcgattgcttcttcaggatcaagaggaatggccaatgcacgagccaaatcattgactgtacctagagggaaaaagccaaaacgcggacgctcctcatgactagcaattccgctgatcgcctcattaactgtaccatcacctcccattgcaaacacgctatccacggagccgacagcttcagatgcgaaccgctcggcatcacccgctttttctgtgtgtgcaacagccacttcatcaaatagttcctgcaatttttttgttgctaattcctcgtatcctgcagctttttcgcctcccgaactaggattgacgatcaatagtgctttcatctcctctgcctccttaatgctacttcgtttcacattttagtataacaaagagccaccagatttgtcttttgtgcaaaccaccgcgaataactctgaccgaatctccaattgaatcgaatagagctgtgtgtaattgccctatttcttattcttagaccaatcgtttgcgtaaacgccccgaaataaaatcaatacaggtaactgtcaaaataataccaagcaaaatgatgcccacacgactccaagatcgtgcattgatagcaaaaatcatcggtgtaccaatccctcctgctcccactattcccagaatcgatgcagagcgaacagctaattcaaaacgatataaagtaaacgacaaaaactctggaatcaactgcggtaaagtcgcaaatcctaaaaccgcccagcgatttccgccagcactcacaacagattcagaaggtccctgatccatattttcgatcgcttcactatataacttggccaacatacctatggaatggacactgacggctaaaacgcccgcaaaagatcctggaccaacagttttaataaacatgatggctagaacaatctcaggaaacgtgcgaatcgctgttaagacgacttttcctgtgcccgacaagaatctaggtgtatttttgcttcgagctgcccaaaacgcaaaaggaatacttaataaagaagaaataaatgtaccaacaaaagcgatggctaccgtttcaatcattaaactgaacaaatcttcgccatccccggtatagacataactccaatccggatggatcaatccgtagaaaattgcccctaagatttgaccaacgttttctttgatagtagctaaggggattcctgcaaatgcccaaatataaatagcaaccagaacgagcacgaaaagccattttctttttttctggggttccgttggcaacatcatagcaatcgctcccttactctattactgatggtatctataagaagaacaacgataaaaatcgccaaaacgataattgccgtttggtcgtagcgaaattgactcaatgatcgttgcaaaaagacaccgattcctcccgcgccgatataccctaagatcgttgaggcgcgaacattgatttcaaaggcatacaaaagataacttaaaaaatgactcgttacctgcggaagtaccgcgtaacggataatcgccagttttgatccccctgaagcggtgacagcctcgatcggtcccgcttcaattgtttcgatcgactcataaaataatttcgtaatcatcccaaaagaaaagatggaaattgaagtcacaccagctaccggaccaataccgacaactgctacgaacagcgccgccaacatcaaatcaggaatcgttcgtacgatattcaaaagaaagcgaaaaatccccgataaccaaggaattgttaggatatttctggctgccagcaaagaaaaaggcaaagcaatgagcgccccaaacgttgttccgacaattgccatttgaatggtttgaagaagaggctccacaatgatcgtactatacgaccaatctggtcgcagcatttttatcagtatcacgttcatttgatccgcattttcaaaaaaacggcgaagatcgactcccgtaatcgatccactcaaaatcaagacgagcaaaaaaagcaccaaccaaagaatattcttccatagtccgcttcgtttaggcaacaattgagtggtcatttttctgtgcctccttgctcttcgataatctcactgccgtagatttcttttaattttcggtcagtggcttcgctaactggtccatcaaaaacaaggcaaccatcacgtaacccaatgatccgtgtaccatactctcgcgctaattgcacggaatgcaaattgacaacgatcgtaatacctaactcttgattgatccgctttaaatcactcatgaccttctccgttgtcataggatccagagaagctaccggctcatccgctaaaatgatttttggttcctgagtcaatgcccgtgcaatcgagacccgttgttgctgcccaccagacaattgatcggctcttgaataaactttttcggctagattcactctttgtagcgattgataagctagttccttatccgcttgtggaaacaatcccaaaagcatctgaagagtggggtgataagcgactcttccagtgagaacattccttaagacactcgaacgttttaccaaattgaagctttggaaaatcatgccaatgtctcggcgaatcaaacgtaattctttgccctttgcctttgtaatggagcgattatcgatcaaaatttcgccactggtgatttcgtgcaagcggttgatggaacgcagcatggttgatttccccgcaccagacaacccaacaacgatcacaaactccccttgatcgatgtcaatattcaaatcttttaaccccagcacaccgtttggatattcttttgtcacatttctaaacgaaatgatctttttatttgctaacgccatggttctcctactttctctcattaaactacttttataaaattgaaaagggtatctgttgatacgataccctttctctgccgcttattgtcctacttgttctgcatattcacgaacgatatcaaaattactgtcttgggagactacatagccttcatgagagtagatatctgaaatgatttgatgaccttcttcatctttaccaatttcgataaaggcatcttggatttttttgtcccattcctcactcatatcactgcgaacactaatggtgtcattcgggattggttctgtgaaatacataggttccacgtcattcatgattttaggataatcttttttcactgtatttcgcgcatcttcaaaaacgaaagccgcatctacatctccgttcaagacagccaaaactgcttggtcatgacctttgacttgaactgtcgttacatctttattgatgtctatcccttctttttgaagttccgcaactggccaaacatacccagccgaagaggttacatcttgtgtagcgatcgttttccctttcaaatcagctaattccttgatatcgctgccgctcttgaccacaaccattgatcgatagctatccaccaattcatctgtcgcttcaccaccaggctgcttgattccatatcgctgtgcctgcagtaatacttttacattgctttgttcatgagccaaaacataagcatttggaggcaaaaagcccacatccacttgcttagaagccattgcttcgacgatcgtattgtaatctgttgaaacacttacggtaactggaattcctaatttatcacttagcagcttttcaagcggtttcgctttagcctctaacgtttctgctgcttgcgagggcacaaattgaactgtcaacttttctggaacatattgttcctctgcactcgaactagattctcccgctccgcaagctgctaatgccaatccagttgctaaccctaatccaacgattcctacctttttccaaagcttcattcttcttctcctttgtgttaaaaatcagaacaaccaattaacgaactttacctttttgattatagaaaaacgtacatttaattacaactattttttcactataaatggatattttttagtaaaatcaatctaatcacgaacattaacttgtgtaccttttctcaatcaaagagtatttcacagtctgtcaattgctttgctctactttaaaaagagtaccaaagcaatttattgtttgtatttacaacacgtaaagtttctgttaatcctctcgaagatagttgtgatctattggacatgtcatcaatcaggaaattctctacttttgaggctataattctctcttcacatctaccggtaactagtttgaccaagattaccaaaacaaaagtttgaagagacagatcgaaaagacgatcgcctattcttccccggacttacaacagcagtctttcaagtgcaaaaaaactcatggctgtcggctcctcacatccaacaccaccatgagtttattttcaaccagattatctccattctttcaacaacacggtctcatcatttacaaactctccagttgcaacaaatccaaaaccttcgtacatttgtttagcgatcgtattttctttaacggaagaaattcgtagttcttttgcttggatcgcctgccggaaccattcaatcgctgcttccattgcctgtgatccatatcctttttgctgaaagcgatgatcaatcataaaacgctcgatccaccatgattcttttgcataatcttcatccgcttcgtaataactaaacaataagaaaccgatcatttcttcttgatgataaatcgcaaaagcctgccgagcttcttcatatacagcttccagcaaagaataccaattaggcgcaacaaatttttcttgttctttggttgtttttagttcaatacagccacgataattctcttttgtgattggttttagccggatcatttcagacctcctctaattaaatcgctttcaaacaaaccgaataaaaaaagatgacttactaaggatatagtaaatcatctaactgtattattaagcttcttgcgctactgggtatacagaaacttgctttttgtcgcggcctttacgttcgaaacgaacaacaccgtcaacttttgcaaataatgtatcatctccaccgatacctacgtttactcctgggtaaattttagtaccgcgttggcgataaaggattgatccacctgaaacagtttgaccatcagcacgtttagcacctaaacgttttgattgagagtcgcgtccgttagaagtagaaccgccaccttttttgtgagcgaagaattgcaaattcattttcatcaacatgagatgcacctcctagttttctttgattgttttaatttggatataatcgctgtattcttcttgaacagattgcagaccaatcaatagattctctaaaagaatctgagagatattcgactgctcttgggtcaaacgaggaacaagtttaacaagaaggtagccaccttcttcattgttcgcttcaacgattggtgttacaccagccaaagcatcgatcccatttaccgcactgatcgctaatgctgaagcagctgcgcagacgatgtctttgccatattctcctgcttgcgcgtgaccggtaagttcaaaagaaacaatccgaccagagtcattacgcttgaatgtccctttgatcatattcgttaccctacttttcgtaagaattatgcattgattgcgtcaataacaacttttgtgtaaggttgacggtgaccttgtttgcggtgtgaatgttttttaggtttgtatttgaaagttacgactttcttttgtttgccgtgtttttctacagttccttcaacagttgcaccagcaatgattggggcacctacttttgttgattcgccacctactaagatcacttcatcaaaagtaactttttgtccagcttctacatctaatttttcaacatagattgcttgacccacttcaacttttacttgtttaccaccagttttgataattgcgtacatgctctaaagcacctccttctattatacttagactcgccatcccaagtgactttcgtacttaataacttgttctgtgcggttgtagctgtggagtccacaattacaacagattaactttatcaaaatgtttccgtaaagtcaatgaaaaataatgatttatttttgtcatgccgctttactattttttttaagtaagttgttttactatagaagaaagaaacaaatgaggtgttaaaatgaactacccaaaaaaactagctgagccaatcattgaacaatcaaaagcctatcagcttgaagggtttgttcctggtcaaggaccgcttcatcccaaattaatgatcgttggtgaagcacctggacggaccgaaatcgagaattttattcctttcagtggccaagcaggcaaagaactgatggcctctttggcgttagtcggactgacacgtgaagaggtatatatcacgagtgcagtacggagccgtccctattcgatcaaagaacgaatcaacaaacgaagtggcgcacatgaagtagtgcaccccaatcgaacgccaacaaaaaaagaagtcttgttgcatgcgcctttattggattacgaaatccaaaaggtggatccgcctttgattgctacggttggaaacatcgggttacaaagattattaggcaatcgctattccattacaaatgttcatgggcagccaatcagaagtgcgatccaacagttgaatgctgaaaaaaatggttatacgtggtctgacaaacaatacctgattgttccaatgtatcatcccgctgccattttttataatcgaacattggctgaacggatccatcaagattggtctggcttgaatcgcatcagagagcatggcttgcactagcatctcgcaattctgtcttttagttgcggcgataatgagggattgttttttcataagcagtgattttttcttcttcttgcaacgtgatgccaatctcatctaatccattgaccagtttatgcttccatgttgcatcgatctcaaaaggatagaccgtttgtttgacagttacgtgctgtttgggaagatcaatagcgatcctctcatcaggagccaatgctgccaatacttgacgagcagaaagcgataaaacgataggcagcaagccgtttttcgttgcattcatataaaaaatatcgctaaaactgccggcaatcactgcacgaaagccgtagtccatcagcgcccaagccgcatgttcacgcgaagaaccagaaccaaaattatctccagaaatgaggatagatgcttctttgtattctggaaagttcaaaataaattcaggatttgaacggcgatttggtaaatagcgccagtcatcaaaaaggtattgaccaaatcctgtcttttcaacccgttttaaataatttttcggtaaaatttgatccgtatcaatattatcattcattaatgggatcgttttcccttgatagtaagtgaaggcttccattaatttttcctcccgacgatttctcgaacatctacaaagcgtccataaacagcggcagccgcagccattgctggactgcataaatgggtacgggcattcttaccttgacgtccaacgaagttccgatttgatgtagaagcacaatggacgcccgctggtactttatctggattcatgcctaggcacatggaacaaccaggctctcgccattcgaaacctgcatctttaaagatctgatctaaccccagtttttctgccgcttttctaactggacgtgatcctggaaccacgatgcctgtgaccccatctttgattttttttccttccaaaatagttgcggcttcttgcaagtcagagagtcgaccatttgtgcaggaaccgataaaaatatattcaattggaatatcttcggctcgctgtccagggtgcaatgccatatattgataagcttgttcatcattatggtcacgaatttcaggaaagactccactgataggcactcccatctcaggattggttccccacgtaatataaggttccagctgagaggcatcaagagtcagttgggtatcaaaaacagcctcttcgtcggtttttagcgtttgccagtctgcaattgcgtcagcgagctctttgggtgcatattcccgacccgcgacataagcaaaggttgtttcatcaggggcaatcagccctatcttcgccccaccttcaatcgacatattacaaatcgtcatgcgctcctccattgacagattccggattgtttctccataaaattcaatggcatgacctactccaaaatccgtaccgtgagtggcgatcagggcaagaatgatatctttagcgtagacgcctggttgcaaagttcccttgatctcaatccccatacgttttggtttcgtttgccaaatcgtttgagttgcaaaaacatgctccacctcacttgtgccaataccaaaagcgatagctccaaacgcgccatgtgtggctgtatgtgagtctccacaaacgatcgtcttccccggttgtgtcagaccggtttccgggccaaccatgtgtacgattccttgtcgggctgagccattgtcacataactgtatcccaaatgcttggcagttgttgcgcagtgtatctatctgtttctttgcaaccaaatccgtgatcgtaaaaatatctttagtcgggacattgtggtccatcgttgcaaaggtcttttcagggcaacgaacacgccggccagcttgcctcagtccttcaaaagcttgaggagaagtcacttcatggatcagatgcagatcgatatataacagctgtgcctcaccttcttccagcactacatgacgttcccagagtttgtcaaataatgttttccccattcagtagccccctaattttttgattaccgcattcgtaaattctgttgtagtagtattccctccaagatcacaagtcacgaccccatcttccatcacttgatagcacgcctgctccatctgatcagcaattgatttcatcccaaaagaagttagcatcatccccacagacagaatcattgaaatgggattagcaatatctttgccggcaatatccggtgctgaaccgtgaatcggttcatacagtgaaaccccagaaagactatgacttgcactagccaaaacacctaatgatcctggtaggactgacgcctcatcgctgagaatatcgccaaaaagattttcagtcacaatcacatcgaatacagttggctgttgcaagatcttcatagcggcagaatcaacatattgatgtgttaactgacaatcgggaaattcttgcgctacttcattcgccacctttcgccataatttgcttgttgccaaaacattggccttgtccacggacactactcgccgttgtctagttcgtgcgatctgaaacgcctttcgtaagatacggcgaatctcttccctatggtaataattcagatccgaagcctctgttgccgatagctttttttctccaaaataaatgccgctcgtcaattctcttaccagtaccagatcggttcctttaacgatctgctctttcaaaggagaaaagggtaaaaaagcatccgttactttgatggggcgaatgttggcataaagatcaagcgcgcgccgcaagtccaataaacctttttccagtgtataagctgcattttcccacttgggatccccaatggctccgagcaaaatggcatccgcttgctgacaagcttgcaatgttttttttggcagtggtgtgccatactgctcaatggcttgtccgccaaatgcataagactcaaaagagaaatacgggttgcttggcaaacacgcctttacaatttgcaatgcactggtcatgatctccggtccgatgccatcaccagcaagaacgacgattttcttcatttattctcgcctcgattcttcaaagcagcgctggcttgtacataggcttttgcagaagcttgcaacacatcaaaatcaacaccgatcccactgatttgtcggtttgtctctgcgcattcgatagctacatgaacttctgcttgcgcatcttctccactcgtaagagccgtgatttcataatttagcagtcgcggttgctgatcaaaaatctggtcgatcgaattatagattgcttgaatgctcccagcgccaattgctgaggcaacataagattgatgatcttttgtgatcgataccacggcaccttgatgaccattggagacatattgtagctgaacagcctctaattcaacgccctctgtttgcgtgcgaccttgatccgctgctaacgccagcaaatcctgctccgttacttgtttctttttgtctgccagttctttgaatcgtttgaacaatgcatttgtttcctcagagtcaaactgatagcctaattgattcatcttttctataaacgcatgccgaccagataattttcccagcggtagcgaatttgtttgaacaccgactaattgcggcgtaatgatctcgtatgtctcaggattcttcaagacgccgtcttgatggatgcccgattcatgtgcataggcgtttcctccaacgatcgctttattcttaggaacagcgatccctgatagtcgagcgactaggtcactggttcgtttggtttcgcctaactggatattcgttgtgcagtcatagaaatcttgacgcacatgcaatgctaatgccacctcttccaacgccgtgtttccggcccgttcaccaatgccattgatcgttccttccacacgagtggctccgttctcaatagctgccagagcattcgccgttgccattcccagatcatcgtgacagtgggaggaaaacataatcggttccttgcttttggtattggcaatcaaataggcaaataattcgccataggcagtgggattactatagccaacggtatctggaatattgatgatggtcgccccggcatcgatcgctgtttgaaccgcttctaacagaaaatctttttctgtgcgggtcgcatcttctggagaaaattgaaccttgtcaaataaggttctagcataggtaacatgttctttgattgctcggattacttcttctttagtcatggctaatttataacggcgatggacttcactggttgccaaaaacacatggatctggggacttactgcttgctttaatgcctcataagcgcgatcaatatctttaatttgacagcgtgccagacctgccactgtcatcgtggatacagcagttgcgattgcttgaaccgctgcaaagtctccttccgaagcaattggaaaacctgcctcaattgtatcaattccccatttttccagctgtaaagcaagctgtaccttttctttcgtattgaaattcactcctggagtctgttctccatctcgaagggtggtgtcaaaaaactggatctgtctcaaactgattcctcctctggctcatttgttcttttagggtataaaaaaagcactccataaaggtcttccctttatgcaatgcgaataggactcttctgtttcacgtcatcagatcatgaaatacaaaaaagagtcctcacggtaataataagttgctagtgttcatcggcctatttctattcattttattcacctgtcactttctgcttctcgttaccttatataagaagataccgaaagacactgcatctgtcaatgcttttaattgaattttctgaatatttagatagataatattagagaaaaagaaataaaagtgtccttttctctcttcatatctcttagaagtaagaaattattttgaaatacgttcctttaaaacagatttttttcagcgaatactggttatatcttcacagactcttaacacaatttaaacattgctctgttagtatcattgtataccaaaaattatttttcaacctttctcccctaccagtcattcgactggtttttttgtcttactgagcaaaagatctgttcttttcccaagtagaaaggattgaactcaaagagagttatccgtataataagtaacagaaattatttaggaggatcaggatgcgtaacgaaatgatgcatcgtccagtagtaaaaaaagaactagtggcgtttatgcgggaaaaacaaaagcaattaactgggaaattaggtcaaatcgaacaggcagctcatgaaaaagaagttcctattattccgcatgagacagtggtgttcctgcaatttttattaggacaaatgaagcccaagcaaatattagaaatcggtacagcaatcggcttttcttcaagtttgatggcacagtatgtaggtgatggtcacgtaactaccatcgatcgctatgatgtcatgatcaaaaaagccagagaaacttacaaacaattgggccttgaggataaagtcactcttttagagggacaggcagcagacgttttgccgacacttgatggcccttacgattttattttcatggatagtgcaaagtctaaatacatcgaatttttaccggaatgcttacgacttttacgtaaaggcggcgtgttaatggtcgatgacgtctttcaggcaggaacgattttagatcctatagaagacattccacgaggacaacgggccatccaccgtaaactaaaccttttcctcaatacagtgatggatcatccccaactgacttctagcttaattcccttaggagatggcgttatccttattacgaaagaagcagatcatgtggacgtggctacaaccagcgagtaacgagtcattttaaagaaagttggcaaaaatagcgaaaagcgattgacattaggcgctcctttttctataatgttatttgttgctgacttgtcatagtagctcagctggatagagcatccgccttctaagcggacggtcgggggttcgaatccctcctgtgacgttatttaaccgtcgagaacccttgttcttggcggtttttgtttgttcttgtgccaaatgtgtgccaaattgatttagtttttttgaaattaggctaactagaaagttgaattatatatataagcgccaaataagttatagattctttacctctttttctgatacaattaagaaaaaagaagaggagtttataacgaacatgaaaaaagtttatttgggtgtttttattggtatcaatttattattcttatcggcttgctcaagtcccgaagataagaaaacagttactcaaggttctgccactgctcaaaccgaatcaattgttgaatcttctgctgaaaatactactgaaagtagcaccgtagaaagcaatagtgccaccgtggaccgtgccgaatattcagcgaatttttcagaagattggaatggcctgaccacgaacatcaataaagtagtgattgtagaactatccgatgatgagattgaaatgcaaggtctagaaaataaatacgctgttcaagtatatttcgaaattaccaacaattcggacatggattttgatacttatccagaccaagcaacaatggttgtggaaggtcagcaaatcgaagctgagatgtttttaagtgatagtattggtggagaaatcttaagcggtgtaacaaaagaaggaattgtgacattttcagtacctaaaatagaagatgttagcaacgtttctaatattcgattgaaatggtctgctagctacgacaccgaaaattatgacgaggataattataaagattttgatgttacattcgatttaactaaataatcgatgagtggcagaacttatactaaggttgtttgatatgaataaaatcattaaaattgctcctaccttatttggtagagagctttttttattttctgttcgctttacaaaacgaacgtaagttcgtatactttccgtaaggagtgagctattatgggaagttttcgatacgaacttgagcccaaacgtgacattctttttattgatgtaaaatcattttatgcttcagttgaatgtgttcaacgtggatttcacccaatgaagaccatgttggttgtcatgtcccaatctgataatacaggaaacggactggttcttgctgcttctccattggcaaaaaagaaattgggaatctcaaacgttactcgtgctgataatttaccgaaccatccgctcctattcaaggtccctccacgcatgaacttatatataaaagaaaatctgaaagtaaacaatgtatttagaaaatatgtagccgatgaggatctactcctctactctattgatgaatcaatgatggacgtaactaaatcgctgaacttgtttgtgccagacaaaagcttgtctcgaagcgaaagacgatggcgactagctaagatgattcaacgtgatgtctatgacacgacaaagctatacgtgacggttgggattggagacaatcctcttttggccaaactagcattagacaacgaatcgaagcataataaatcacttattgcggaatggacctatcaagacgtggaaagcaaggtttggaacatctctcctatcacagaattttggggcattggatcacgcacacaaaaacgacttgagcgaatgggtatagaaacgattgagcaacttgcgaaggctaatcctgatttgttgcgaagtcgaatgggaattattggtgagcagttatatcatcacgctaatggaattgatcgaacaataatctctgagccagctcctcagacgagagacaagagttatggtaatagccaagtactaaacagaaattattatctccaagatgaaatcgagattgttgttaaagagatggctgaacaggttgctgcacgtattcgtagacatcactgccaaacttcttgtgtttccatttacattggtgttgcttttggagaaacacaaaaagggttctcacgacagatgacggtcccacctactgataacacaaagaagctagttgaacattgcctttttttatttcgtaaatattatactggtcaagtcgtccgtcatgtaggtatcacctattcaaagttaatttacacatcaagtattcagcttgatttatttgctgatgctgaggagcagataaagcagattaaactggataaaatcatcgataaaatacgtgaaaagtacggatttacttctagttttgataacttctcattttttgttaacccatcaccaatatctaaataatgtaaaattccttgttgttttttcgatgtatctttaaccaaaataactattgttactcccgtcatgatatcaaaaatatttcctccttcaatttttgattgttctttagttttccctctaatggctccttttaggttcaaaatataaatagcagaaaattcgtctatcaaagatttacgcattccatccatggcatttccatctataaatgaattattagtaatgaaaccaataaccccattttctttgatttggttgctagcccaacgaattgcacgaatatacgaatcaattatccagaaggataaaactcatgaacttccttaattgaaattacttaggtgaacccgtattcaaaaaacgttgttttaccgctaaggacccttggccttagcggtttttgttttgctttgtgcccaatataaatcaaagatgcactctttgttcaaccaaaaagtgcatcttatcaaactagcaagttcttttattttttcatctcacgaatgtccgagttatcacgaaaaaactgtaacacacggattcataaatcaattatctaaagacgttggtcattgctgctagtcatcaatcatcttctgtcgtatttcttagcaataaaaaccaacttctctttcgatcacgtcatccaagcgatacgtacgctaccgttgttctctgaaagttatttaccgattaattagcaacgtgtatttgctgttgttcaactaacggataactaatcagtttttcactgtctaggtcttctttatgcatatctacggcgacgatttgactattttcataggtccgatagtaataaatccctttgtcgacattgcagcaagaagaataaatggtatattcatatttcccgtctcccacatcacataatcctttttgctgttcgacagaccctaaaatatggaaaaattggctgatactttctgattctgaatcaccagatacagaattcagttttgtgaatgcagccttcacaaatcgagacatcgaggacaaatccccaggcaacccaattccgcccattcctcgactatactcattcaattcgattgcatctgagaaggtattggttggcgttttactagataaagaacgatagttatttaaattaaacaaatgatagtcaaaagaaggattgttcgttaggacaccaacaggattatcatagatatgaagtccgtctttcatactttctacaacgattgaagactctttatccgctaataaccagtgtaaaggcgacagcggaagattttcgctaaaattgatattaaccaaattgattttattcaacaattcttttgcttcagctactgtgctgcattgccctaatatccagggaatgaattcaaatggtgtgacattgtctttattctcaaccggttctttgtaatctgcaaaaccagcaaaatttaacccagccatgcttaaacctttttcattggtagcatcataatacagcggataatccgctataccagcagcaatcccgatcatcgcataatgctgtgataactcaccaacttttcgaaaagacagcttatagttcctaggagtaatcgtgactacttcttcataagacagctcataatcaaagtttctaccaaaatagtgatctcgcgttgaataagtaattgatgtacacatattttttcctcctaatgttctttttttcacttatattttactcctattcacttttttttcaaaagaaatgattgtgtctcgaactcagttcttttattggttataatcatctctaggaaaatgaacgttaacaagtactctattcgtacttttcaataaaacttatcgttgttacactagatttcatacctatcgtaaaaaagcattaattatcaaaaaaccttccaataaaagatgtattctacatacaaggaggcagtgaggtgattatggattatacaaaagacattcaactggcattactctacattgaaaataatttgactggcgatctctcctcaaaagaaattgcaaaaaaagccggcatgtcagaatttcattttcagcgtgtatttaaaaaacaactgggcatgggagtatataaatatcttcaaaaaagacgtatggcccatgcttccctactacttttgaagagcgaattgaagattatcgaaattgctctgatcagcggtttttcctcacaagaggcgttttccagagtttttaagtcctattatcaactccctcctcgacaatatagaatccaatttaaaaacttttttagggggaatcaaaaaatgtgtgagacaaaaataaatggctggttgctttctggaaataattttgacaaatatgaagtgacaattgatcaaatgaattttcatagtggaaatcagtcagtaaaaatgagccaaacagagagcttatacacagagaattttgcaactgttatgcaacaagtgagtgcaaaaaattacattaatcaacgtgtgcgattaagcgcatacctaaaatcagaatcaattgaaggttggggaggaatttggttgagaattgatggcaagaattttgaacaattagcgttcgataatatgcagaatcgtccagtaacaggcacaaatgattggaattattattcttctgtcttagatgtctcacaggaagctgaagttttaaattttgggtttttgttgcagggaaaaggcactttgtgggctgatgatttttgtttagaaatcgttcccaatgatattcaaacaaccgaatttaatagtgaacagtattacccaacggaaccccaaaacttgtcgttttcggaataagaatagttaataaatgagctacagtagaattcaagatgccacaagaccttatggaatactactgtgcttgaaggatccaagcaaaaatcctgctcccctccttttcttatacgaaaaagaaatagcattctgaatcaatgcgaggtaaaataaaagaaaactttttaccaatcagcttattctgaatcggagaggaagctttctatggatacaatgatgaaaagtatcattacagaaaaagatttattacggcagatcctgcttctcgaagagttatccaatcacaaaacgattacggcaaaggcattggctgcttcgattcaaactacagagcggactgtctttacagatattcagtatattcgagagcatttgcctgacggatgggaaatcgaagcgacaagtaatggcttttctttacttaaaaaagattcccaactaaccaatcaattatgggaaagcttcttgccgctttcaattggcgctatgttgatcaaacagttattctttgcaaaaggaatctcaacacaatctttcttgcatgacagtggtatctcttttgaaacattgaaacgtcatgttacaaaaatcaaccgtggcattaaaccatacaatattcgaattcagttgaacgccaagcaagtcaaactgtcaggtagtgagatcagcattcgagttttcttccatcgtctgctgctgccttttacccacaataattatttctttgaagattatgctattcatgaatcacattatcttatctttttacagtcactgaaacgtcaagagttggacgttctttctgaagaaatttttggcacttgctggttcttcatcaatacaatccgaatcaaagccaattgtcgggtcaatgcactcgcttttgatcctttagatccgctttttttacaatatcatcagtcgctccagcaagtttatcaaaaagaaggcgtctatttgaatcaggaggagtgtttctttagtttctattgttttctggaaagttggaattacaacaatcagtggacaagcaaaattgctgtcacactagatgcctatcaggaaatcaaacaatccgtccagcgatttgttcaagaacttgggcaagaattggcgattcccctactttctgaaacccagttagcggacaatttgctgcttttggtcttaaaattcaatgaatccgcaaaactgtctgaacaatttcaattagagtatcaagaaatgatgcacattcgtcaacacaactatcaagcaatttttgaacgattacggaaatttatcttagatccaaaatttgccattgtaaccgatgaacctaagtatatcttgaatatggcttcactcctcgtacaacaagctgtgcttcaggcacgaccagtaacgacccgagctttcttcttctttcaaggagaaccagcatggaaagttttcttgcaacaggaaataagtgattatttgggttctaggatcgaattagtcccagtcgaaccagctgaattcgcagggatgactactcgaaatgacgacttcattatttcgaacgtccctttggatgatcccaaattaccagtcttctatctttcaatgctgccaactaaaaatgagctcaatcaattgactgagctcatccaaacctattatctgatcaaccaatgacttagcttaattcattggttgtttttgtattttgccgattggcgcgccgcttcattagatgcttttcaacttcaaccaccgcaaagagtaagaagccatttactgcgatactaagatgctgtacaagcgtcaatgtagttgtcccaatcagttgctgcgcaactggcaacaccagaaccattccttgcatgatcaccaagattcctagagaaatgaacagtgcccgattttggaacatactcttgttcaatgctggctctaaaagctcccgacaattcaacatgtatactgcttgtcctaatacgatgttctgcaggagaatcgtttgctggactgcttgcccttcaaattgcatggacaaaaagtaagcaggaatcatgatcagtagagaaacatagacgattcggaacatgctgtacatggaaagaattccttcattgactggacgtggcggccgatccatcacatctttactcgctttttcgaatcctagtgcataagacaatgtaattgttgttaccatattgacccagaggatctgaactggagtcaaaggtaatgggcgatttaacaagagagcaaaaatgacaatcaatccttgcgctaatgctgttggcaaaaagaagttgatggtttttttcagattgtcaaagatccgtcgcccttctttgactgcattcgcgattgtatggaagttatcatctgccaaaaccatatcggctgcttgcttgcttacttcacttcctttgatccccatagcgatcccgatatctgcttttttcaaggcgggagcatcattgacaccgtctccggtcatacctacgatctcaccattattttgtagagcggtcacaattcgtagcttgtgctctggcgtcgtccgagcaaaaacatccacgtgattgacttgctgtgccaactcctcatcggtcatttggtcgatatctaatccttcaagaactttcttcgtatgtttcaacccgacttgctcgccgatggcttgcgccgtttctttgtggtctcctgtgatcattttgactctgatccccgcttgtaaggactctctcactgctttgattgcactgtcttttggcggatcaatgattcctgcaagacctatgaagactaaatcagtgacttcttcatgagcaacttgactggatgctggaactgtcttgtatgcgaaccctaagacccgctgtcctttctgtgctagctcagaagccgcttgctgccaataggatacttgatcttctgatagctgacttttatttagcaaaacttctggagcgccttttacatataagattgattgatcctcttgcaaaggatgcaaagttgccatgtacttgtaagtagagctaaaaggaatttttgctgcaacttgttgcaagggtaattcctgagtctccacaaactgcagcagcgcccgctcagtaggattaccttgcaaatctgctgcccgctgagaactatcttgtttcagatcttgacaatttgccatgatatcgtacatgagcgcttgctctttttcggttacagtgacagtatctacaacggtcatttcattttttgtcaacgttcctgttttgtccgaacaaatgactgtcattgcaccaagcgtttccaccgacggcatcgtcatgatgattgcttgctgatctgccatttctttgacacccattgacaaaatcatggttaaaacagctggtaatccttccggaaccattgctacgattaacgcgatcactgaggaaaacaacacgtttagttctagaccataccggaatgcggtaaagaaaattaagaagagaatcagcgcgacaataccgcgaaaaatctgcttgttcaactgatgcattttctttaccaacggtgtctcttgtgatttcactgactgcaaagcttgattgatcttaccgatttctgtctcgtcgccagttgctactaccacaccgatagctgacccactttgaacaagtgtaccagagaagaccatgttcttttgatctccaataatactgttttctgtgatgacgtgttctgttttcttgactggctcagattctccagttaagatcgactcttctacgaccaatccatgattttcgatcaatcgcatatccgctggtacgacatcgcccgccttcaatgagactaaatctccttgaacgatcgactctgcggcaacagtttgctgcagtccttccacaatgactacggcttcttggcccatcatttgttttaagccgtccaaagattcttccgcttttcgttcctgccagtaacccacaatgccgttgatgataacaactagaagaatgatgccactttctacataatcacctgtaacagcctttaaagctgcagcaaccatcaacacgatcatcaacagatccgtaaaatgttttgcgattttttgccaagttttgatttgaactttttctgcaatgcgatttgcaccatctgcttctaaccgtgcctgacgttctttatttgaaagtccctgacgatcggactgtagctgcttcatcaattgttcttttgaaatttgataccacttcattgccattccccctaatgtctttttagctttcgcttgtctataagtataggggggattcttaaaaataaacggtcgattatttcagtctaatatgaaaaaaatgcccattaaaaaaacgctctattagaaagatccatttcctccaccatcaccatgattcgctcttgtgattttttcatgaaacatcgcgatagcctgtgcggtttctgccatatttgcgagcgttacactttttttcattgcttcatcaaggagaagtgggcctggttgaatactgaaaataccagcaaaatactgaccgatctctcctagatcaggctccctttgcccacacaatgcaacaactggaatagcatggggctgtgcgattttggccacacctaatggcacttttccggctgcagtttgacggtcaaaacggccttcaccggtgatgatcaacgtagcatcactgattctagtctctaatttcaacagtttcgcaatggtcataaatcctggacagatctgtccccctagtaagaccatcgcaccgccgatacctccagcagcacccgttccagcgatcccatttaaatcaatttggtattcttgctgcacgaaatacgctactttttttgcttgctgctccaatacctgtaccgtttgaggtaaagcacctttctgaggtccgaaagtagttgcaaatccttcagctccagtataaggattagttacatctgctaaaaccaacagttcgataccagaaagcaatttctgcactgctgttatcgaaaaataatttatggtcaacaaaggattgcgcgcatctgccgcaggttgatacattagttccgcacctaatgcttccagtaaacccagtccgccatctgttgttgcactgccacctaacgttacatagatctgtgctactttttcattgattgcatctgcgatcaaaagacctagcccgtaggaactagcctgtctggttgtttgatctgatggatcaagtaattggataccgatgattgctgcacattcaataatcgctattcgcttttgattgattgttgtcagtaaatacgaaactactcgttcttctcctaggggaccgacacttgttacggatttatactgtcctccataggcagcaaataacgcagccattgttccttctccaccatctgcgatggggattgattctttttcccattgtactggaaaccctttaagtgctgcctgatttaattcttccgaggtagcactccctttaaatgagtcaatcattgctatcactttcatatcgaaccctcacctcgttttctttcattaaacactgaaatacgtcttacaacaagaaaaaagagtgttgctactctttatcaacccatggttaactttatcaatcaaaagttaacttgttctccattgtgctcctctctttcctgttctacaataaagctagccaattcaatggaggtgcgtcatggaattaccaattggacaggaaatagctaagagaagaaaggacaaacaaatcactcaaacagagctagctgattttatgagtgtttctaaggcctcggtttctaaatgggagacgggccaatcttatccagatattaccttgttgccactcctggctgctttctttgattgcagcgtcgatgatcttttagtgatcaattctcagctaacaactcaagaaatcaagcggatttaccagttgttgaaagactcgtttgaaactaaatccgctgatgacatgttacttatgctgagaggattcattcgccgttattattcctgctatccatttctgctgcagatgggacttttttatctgaatcattgggatctgttgcctattccagctcaagttactaggacagaacaagtaccaaataatgagaaaactgttgaggatcaacgaaagtattacttacaagaggcggttaaattatttgaattagtcaaaactaacggttccgctgacctcctgcaacaagctagctattatgaagcctattcaatgcttatgcttggtcaggcagaggacgttttaggtgtattaggaaataagacacccgttttcttgccagtggaatctttgattgcagctgcgcaccaacaaatggcagatggctcagccgcagaaactgttcttcaaagtgccatttatcaatatgtcacagttttactcagtctgttgactaactacacgcttttgctgaccaaaaaaccccaagctatggaagcaacttaccaacgagggctggccttttgtgaaacatttgacttatccagactacatccagtcattatgctcaattttttggctgcctgtttgaccacttttgctgtacaaggcaatagtgcccgcttgctttgcgctttgactcgttatgtctcattgctggaaaaaacagaagatccttatctccttcatggtgatgcgtactttgatcagatcgaaagttggattgatgagttggaacttggaaatcagatgccccgtatttctaatatggtaaaaaaacaattgacagggctgattcttgaatcacccctattgcagcccttcaaagatcaacaatcatttacagaattattccagcgcttgcaagcagtagccgcccatactgcagatgacactcatggaaaggaggaaacacgatgatgaccacgagcattccagaaaatattggtgactatctacccattctgatcccattagcacttttgcaattcgggttgatacttgtttctgttttagatatcgttaaacagaaacactttaaattcggcaaccgcacgttatggatacttgtttcttgtttgattagtattatcggaccaattttgtatttcacttttgggaaaggagaaaaagaatgaacgtcattgagatcaatcaattatctaagtcttttggcgaaagaaaaattctagatgccatttcttttgtcgttcccaaagggagtgttgtcggctttgtcggggaaaatggtgctggtaaaacaacaacgatgaagctgattttaggcttgctaaagtcagatagtgggcagatcacggtctgcgatgagccagttgtctatggaaatgctcaaacaaaccgtaagataggctacttaccggatgttccccaattctattctttcatgaccgcaacagaatacctgaatttttgcggaaaaataagcggtcttggcaaacagctgactagccgaatcgatgagattcttcagctggtcaatcttgaaaaaaacaccaaaaaaatcagcagctactcacgggggatgaggcaacggctgggtcttgcacaagctttattgtcaaaaccagaaatattgatttgtgatgagccgacttctgcgctggacccgctgggacgcaaagcctttctagatcttttacttgccatcaaacaagaaacgacagttcttttttcttcacatattttatcggatgttgaacaaatttcggattacgtggcgattttacatcagggaaagatcaaactctttggtgaaatggaagaattaaagacacaatttcgccaagaagattatcttcttcaatttgccagctcacaagaaacagagcatttctgtcagctcgcgaaaggtgcggcgattaattggacgagggaaaaacatcaactgattattccagaaaatcaaacttttcaacaaggccaaaaagtgctgcaactcatggctgaaaatgaattggtccccttactcttccaaaaaaatgaatcctcgctagaaaaaatctatttggaggtagttaaatgacgcagctaacagtttttttaagaaaagaagtattaggcggctggcggaataaaaagatcatcatttgtggagtgatttttctgatggtgggcatgctctcgccttttctggcaaaaataatgccggatatcttttcttccatggtgacagatgggatccaaatcactgtttccacgccgacatctgtcgattcgtggatgcaattttatggcaatatcggttcattgggtctcttggtttttgtgatactctttgcggatacgatttgtgcggaaattgagcaaggaactctgatcaatctaatcacaaagggattgccaagacaaacgattcttttagcaaaaacactttatctttatttcctttggacacttttctatgctgccgcttttctcatttgtcttctttatacaagaatttatttcaatgactctttgacccatcatcttatcagtgcgggttttagttattggttatttgggctattgtcaatcagcttactgctgttaagctccgcatttgctaaaaatgtttaccaagtcttactctttttagctgctttttatggtattggcgtattgggcagtctctttgaatctctccaaaagatcaatccttattcattgtccagccagacaattgcttatattcaaggaaattcagagctgatggacttcttaccagctgttctgatagctgtagtcggatcgtttttgtcattaatcattagtcgttcgatttttcaaaaaagaaagctttagactaatttgattatttctgggaagtagtaaataacagcctctctgacaattgatgtcagagaggctgttattttgaataagtgatattttttagtcccgacagtaatctcaatctctcttcgcgaacgcgattatcaacaaagggaatcgaagagaggttccctcatccagccgttcttttttctttgacaggagcggatgcaagtgtggactcctttgcttcctttcttttgacaaattgacgctgccctttgagcaagatattcataaagaaagcaatgagatagatcgagcaagcagaaatgatcgcttctctcagtccaaagaccagaaagttcaaaacaatgatcgttgtattggtcaagaagatcccgactgctttttttatgccgaaatatttttcaaaaatcaacggtgggatcgtgactcccccattggatgcaccgatacagtaaagggtaaatatccctaagctaaagaagaagcttcctagaatcaaagaggctgggtaaaattcccaaaccatccattcaggaatccatgctaatatgacaggaaacaacaggcttcccaagacggtattgataaagactttccgctctaaaaaaagaaacgctagtcctaacataatcaagttgattccccagacaatcagatggcgatcaatggctaatcctgtttctataagatacccgattgagcccaccccggccgaggcaatgctgtgaggtaaaagaaagaagttcaatgcaatacagatccataacacccctaatgaaatcaagcctattcgtttgatagtcatccacctgtttcctttctgtatttcaatctattgatcttcttgatattgctgccattttaacaaaaaaagcagcagaaagaagagtcaaatttttcatgtcgctatgaaaaatttgactcttctggtaatcgctaaaacgacaacctttatttaattcaacggatttttttataacaaatgattcgaaataaacaaagttctcttagccaagaaggttggctgctcactgatttgcgcaagtagatctgctacttgtaattcgacttctcttatctgattgtccttgctcgtttgcagatcagattcaggtgaacactcatgcaaaaaaagcaggaagatgcaaaatcgtatagtcacacatcgcttcttcaatcatccgaatagataatgtcatttgactgcttcgagctttcttgtgcgtcgtttttgtttccgggatttgatctgacaggaagctttcctctggtttcaccaggcaaatgattcgggttaagtcaagtagtttcatcgcttctatgattcgccaggtgacttgtggctcaggcatctcacaaaggtaaacgatttcacaactaatcattcctcgcaagatcctgcctagatctagtaaatcaccttgaaacatgctttctcgttgaggatcaagcaatgtcgtctgattcttttttggcacgtacaaaacaagcgtctcgtctctcgctaataattgttttctgataacagaagaagatcttgggtaccgaaaatcattacttttgtcatacgatttctttcctatttcggctgtatcctaaaagggattacgtgtaattgcaaaattaattcgtaaacgtttctttgcgtaaccgagcttcagcaggaatgatgtggtcatcataatgttccaatttgtattccaatcgttctaccgcttctgtcatggttgcaattcgttcatgcaacgctgcgatttgctctgctagcaattgttttctttgaggaactgtctgactcccttcacgaaataacgccaaataggttgacaaagactcaatcgaaagtcctgcttttctcatcttactggtaaactcgatccacttgagatcttcttcatcaaagactcgaacaccatgagcattgcgtttgactggtggtagaagggcaatcttttcatagtagcggatcgtatctgcagaaagaccgctaagttcacttatttttttgatattcacatagattcctcctgctattcctacgatatttctctagtaaaatcaattggcgcctacaaccgcatgcggaagataaggttcttctaagtaagcaacttcttctgtggatagcttcaactcaatggctggcaaagcatccagtaaatgactttcttttgtcgccccaatgattggtgccacgactgattctttttgcaatagccatgccaaggccacttgtgctcgtttgacttgacgtgtctcagcaatctctgccacacggcgaacgatcaattgatcttgttctttagtctgatcatattttgattgtgctgttttatctgtcgcaaaacgtttcgtttgtgcatcccaatcacgagtcaaacgaccggcagctaatggactgtagggtgtgatcgcaattttttgatcatcacaaagggggagcatttcccgctcttcttctcgatacaataaattcaaatgattttgcatggaaacaaatttggtccagccatgtttatctgcaaccgcctgtgctttggcaaattgccaagcgtacattgctgaggcaccaatatagcgaactttccctgttttcactaaatcgtgaagtgcttccatcgtttcttcgatcggtgttgtataatcccagcgatgaataatgtagaggtctacatagtccatttgtaatcgttctaaactttgttcaatttcaaaaaagatcgctttgcgtgaaagcccaccgctattgggggcttttttcattttagaatagagcttggttgcgacgacgatttcatctcgtggggcaaaatcattcaacgcttttcccaatatttcttcgctggcaccataggaatagatattcgctgtgtcaaaaaaattgattcctagatcaagggcttttttgatgacttctcgactttccgtttcttccaatacccattcatgaaagccgcttttcggatcaccaaagcccattgcccctaaacaaaggggggagacttctaatccagtatgtccaaattttacataatccattgtcgttcctccttaagattgatacttctagcatacgccttcgagtgaactccaagtcaacccctttttaataattaaaaaaattcagattgatcgtcagctcacgataattcgtatcttgataattttcccgccaattcttggcccgcttctcaaaatagtgttcggtttccttctgataaaaaattctcgctaaagaaattgcttggtcaaagcatccattgccctgttctggttgtttttccagataaaaaagaattccttggttaaaaatataggtgattctggggcgcaataaaattgtgcgttcgtccagactctgccgatacagtttctggatctttctggctgctggaagattgcggtgaaacacatatttagaaaaaaagttctccaacagatcataataaagggcattggtttgcggaacactttggtacagcttggcttttttcaaaatgcttttcagtaatagatccatctgttctgtgtccaatgcaaaggtaaaaatactgatcaaacgcaactccatctcaccccaattattgacttgctggagatagctgagtactttttgagaatgaatgaatggacgattatttcctgcattgagtacatcttcaatgaaacagcctaaaaactgcggccaatcatacggactctgactttcagcaaaaaaacgttgtgccaacgaacgagccgactcttcttgattcgtattaagatactcctgcatctgctcgatagacttttcaaaacggtctttaaaagtctgtttcccaacaaattgaaactcctcgatcgtcacattgatattttgcaagcatgtaaaaaactgatcgaccgtcaacattgattttccattttcaaaacgtgaaagttgtgcacttgatatcccttgctgacatgcttccttcaaagtaatccctttttctaaacgtagtttcttaaatgtcgctccatagtccattcacagcacctctttacatatatgtaattattccttcgcttttactttacccttttacaataaaggtatcaagaaaggtaataagaaaggagcaaaaaataatgaaaaaggtgttattggtacattggaaaaatcagggagtcgtcctgcttttaatggcaggagtcgcactttcacaaacgatagccagcttgcaaaatgtgcaggttctaaacagtctcatccaattcgatcaaaaaggatttatccaaggtgttgtagggatggtcttagcctatagttgtttcctgatgtttatttatctgcaaatccgttatacagcctatacatctcagaagatgtccctttatttgcgagatcaattattgactcggctacgatacagtgattatcagacattccacaaagttaccgtaggcaactatgcatcaaaattgagtaacgatataaccatgatcgaaacagatggcttcgccaatatctatcaggtcatgcaaggtgtattgtcttcactatttgccgttatcgcattagcccaatttcattggtcattgatcgtgctcaccttaggtcagtcctgtttgttgcttttgttgccgaaaatcttccaaaaaaagatgaaacaatcagctgtcgctaccgcccaggcaaatgaagcttttttgagtaaaaccaacgaactgttagctggatttgatactttcctaaatttccagcgtcttgattttcttaaaaataaactcttgggttccgcacaaagaatccagtctgcaaagctaaaacaagcacaagtgatggctgctgtctctgtaactggcggaattggcaatgtgactggtcaattgagtgtcttaggttttactggctacttggcttttctgcaaatcgttcccatcggagcgattacagcaacaggaaatcttgcttcgacaatttttaatacattaggaaatatcagttcctatctgtcaaaaatacaaggcacattccctttattcgatgcatttgcttatgagaagccagcgcatgagatttcgctacccagcaaaaaaacaaacgatgcaaaagatcttgtgttggcacaagcttcttattgttatcaaacgaccgatggaaaaccgcaacgaatgttgttcaatctctcaaccacttttaaagctggacaaaagtatgccatcgtgggggaaagcggctcaggcaagtcaacattattcagtttgttgactggacggcgcaaagactatagcggatcgatccgcttgggagaaacggaaataaaagaattccctttagaagaattgcaagacaatgtgacagttattgatcaacgtccctttgtctatcaagcatcgattcgcgagaatctgacattaggacaattttttcccgatgaagaaatcgagcaagcgctaaaaaaagcggaactctttgcagttattgaacaactacctgagcagttagacacagttcttaccgaaacaggtggtaatctttcagggggacaattgcagcgtcttgcactagctagaggcttcctatggaaaaaacctattttgttagttgatgaaggaacctctaatcttgatcaagaaaatgctaaaaagatcgagaaattactgttgcaacaaccgcaaaccgtcctgtttattacccaccaccttcgagacgaaatcgtccaaaagttagatggtgttctctcacttaccccctcctagcaaattgatcgcgatgactcttttatcaataggtcctatttgctaaactgaaagtagctgattcaacaaaaatcaatgctttgattcttaataaagcattgacttttgttgtgatgactttttgtctgctaaacaagaaatgagccaatggaggtttttgatggtcaacccacagctaatgcattatttagaaacaacaatcattccacaatacaagcaatttgacacaagtcactcccctgagcacgtctatcaagtgctcgaaaacagtatagaaatcgctgccccattatcggttgacttagacattgcctctactgttgctgtctttcatgatcttggtctattaaaaggacgaaaaaatcatgaacgcgcttcaagatctatggtagaatcagatgcttttttggcggattactttaccaaagaacagcgtaaaataatcggagaagccgtcgaagatcatcgtgcttccctctcctatgagccacgatccatctatggcaaaatcatttcagaagctgatcgtgatcttgatttttatcggattctcgaacgcacgatttactttgccatcgaaaaaaagagtctttctgatcctgataatctttgccaagaggcatttgaatacattcagcaaaaatacggtccccaccatcacttgaccttttggctcggctattcaaaaaatatcgcaggcttagcagagatccatgaaatgctcacagatccgatcaaatttaacagcgctttttctgattgctatgaacaacgaatgaaaaagccgacttcttgagctaagacgtcaagatccggctttgtttcatttttctagtcgttcgatcatttctttcatcttttcaatttcttctttttgagtttggataatatcatccgctagttctttgacctcaggatctttgatggccgcattggtactggttaaaatggcaatcgaatgatgaggaatcattgctttcatccatttcacatcatcaacagccgtttgggagcgcaccatgaaaagtgaaccacagaatacgagtacactgacagctaaaatcgctagattccatttcttattttcgtacattttccacataaataagagcatgatcatcgccatcacggcccccatcatcaacgccataaataatcgagtctgactataaaagatatgatcccattgaaaaacattcaggtacatcatcccaaacatcacgaccgtcgatactaaaatcatcacaccaaaacgcacatactgtttcatttctatctcctctttccataaaaatatccactattagtctatcaggattgattgttcctactcaaacgaaacgcttaattgtgattaggagacgaagcattgttcactcttgcaagttttttcctggttcctctatggattgccaggtatcaggatttttgttctatcgcttttcctaggctttttttcagcttttctgtcagatctttgcaggaaggaagaatccatgccaaagcaataaattttgcagctgaataagaatgtggtaacttgattttatcacatgataaaatttctaggaggaagttgtatgtttttagcaataaatgaaatccgccattctaaattgcggtatgcactggttaccggtgtcatgtttttgatcgcttacttagtttttttcttgaccgggctagcctatggtcttgcccaagaaaaccgaactgctgtcgataaatggtcggcatcagagattttattagccgaggaagcgaataacaatttgaatatgtccatgatccctcgtaatctctatgatgaagtcaaagcagatgagaaagctgtattggctcaaactgcgggtgtgatcaccagggaatccggtggtgaaaaagttgatgtcagcttttttgggatcgaaccagatcaattcttggctcctaaactcacggaaggcgaacttttcgcgaacgacgatgaggcagttgctgacagcagtttgaaagaggaatacgacattaagatcggcgataccgtcaaattagccggcaatgaaaagaaactgaagatcgtcggctttacagaaaatgctcgcttcaatgtcgcacctgttctctacacgacgattggtgcctatcaagaaattcgctttgaaacaaaagataccagcgataaagcccgcatcaatgccatcgttacgcgaggaacagttgaagaagtaccggatgaattaacagcaaccaaaattagtgatttcatcaatgaattgcctggttatagtgctcaagtgctaacctttgggtttatgatcggcttcttgatcgtcattgctgccatcgttatcgggatctttatttatgtcttgactatgcagaaatctgatatttttggtgtcatgaaggcacaaggaatttctagtcgttacatcgcattttctgtcatcgcacaaactttccttttagcaacggtgggcgtattggtaggattagcggcgacgatcggaacggcgttggtcttgccgcaagctgtgccctttcaagtaaacagcctcttttttgcaggtattagtgtgttgatgattttgattgcgattgtcggtgctttcttctcagtaagaacgattgttaagattgacccattgaaagctattggataggaggataaaaatgagtgccattgaatttaaagatgtgaagaaaaccttcaaagatggagatacgatgattgaggctttgaaagagacaaacttttccgttgaaaaaggagaatttgtcgccatcattggaccctctggttcaggtaaaagtacttttttaactattgcgggaggattacaagcacctacagctggtgaagttttgatcaacgatcagccttttagtgaccagaaagaaaaaattcgggccaaattacgattcaaagagatcggttttattcttcaagcttccaatcttgtcccattcttgaccgttaaaaagcaactgaaactagtcgacaaagtcagcaaagagaataaaacccaatctgcccaagatttatttacccaattaggaatcgataaattgcaaaacaaataccccgaagatctctccggtggtgaacgtcaacgggtggcgatcgctagagctttgtatcatgacccaacaattattttggcggatgaaccaacagccagtctggattccgaaaaagcctatgaagtagtcaaaattcttgcgcaagaaacaaaggaaaaaaataaagcgacgattatggtgacccatgatacccgactaactgattattgtgatcgggtgcttgtaatggaagacggtgtcttaaaggaaaaagaacacacaaaaacacaacacgattaatctgaagccaagaaatatttgataaggagttctcatgaaaaaaattatcgttgtcggcggcggtgtcgcaggactatccgccgctgtcagattgcaacaagcaggttatgcggtcacactatacgaaaaagaaagccagcccggtggcaaaatgaaccaaatcaagcaagctggttttacatttgatgtcggcccgaccattgttatgatgccggagatttatcgcgagatttttgaactatgcggtgtcgatccagatgactatatcccgatggaaaaggttgatcctatgctgcagctctactttgctgatgaagcacctctcaccttttccaatgatctgattgaactcactaaaacattagaagggatttctgaagaagatgcccaaggttatttcgcctttctggcagatatttataaacgctacgtgattgcaaaaaaagctttcatcactaaatcgtttcgaggattctgggatttttataatccttaatccctttgggcaggaatgaaattgaaaacattcaacgatgcctacacttcgatctcaaagtttgttaaagatgaccgcttgcgcaagtcgctagcctttcaaacattgtatatcggggtttctccctatcaagggccctctctttatacgatcatccctatgatcgagttgttctatggcgtctatttcatcaaaggcggtatgtatacattagcgacttcgctggctcgcttatttgaagaattaggcggcgtgattcattatgactcaccgatcgaagaattgatcattgaaaacaagcgagcaacagggattcgtctaaatgggcacatccattcagcagatgcgattgtctgtgcggctgattttccttatgcgatgcaagaattgattcctaatgaaaaaaatcggggcaaatacaccaataaaaaaatcagccgaatggcctattcttgttcgtgttttctcttgtacctagggctggataaaaaatatgaagccaatggcttgcatagcatctactttgccgaagacttcaaaaaaaatgtcgatgacctttttgagtttggtgttttgccagaagatccttccttttatctctatcgtcccacattgaaagatgcctcactagcacccgagggtcacgaaggcttgtatgtgttggtgccagttcccgagctgtccaagtttaatgattggcaacctaatacaatcacgaattaccgcaacaaaattatccacacgctaaaagaaaaaacgattttcaatgatatcgatgagcatatcgtttttgaaacctactatacaccacaagatttcaaagaccactacaacgcttataacggggcgactttcggattgaaaccgacattatctcaaagcaattactatcgtcctcataataagttttcttacgcagaaggtttgtatttttgtggcagcagcactcacccaggagccggtgtcccaatcgtgatgcaaagtgcaaagcttgccgtagaggagttactaaaagatgatcaataaggaaagcacgctttttgaacgatataaggaagactttgcttattgcgagcaaatcatcaaaaaacattcgaaaagtttctacagtgctttttcgcaattacccccagaaaaagcacgttccgtgtttgccgtctatgccttttgtcggcaagcagatgatgccatcgatcgttatcaagacatcgttaaattaaatgaactagaacacggattacgacaaatggcttgcggaaaggttctggatacccctttatggcgggctctttctgttgtctttgcgaaatatgatttaaagttccagccattttatgatatgctcgcaggacagaggatggatctaaattttcagccacctgaaacggaggctgatttgagtagctacagctactttgttgctggaagtgtcgggttgatgttgctgccgattttatctagtcaggcaggcaagatccaagaaccggccaagaagctaggggaagctatgcagcgaacgaatattctccgggatatcggggaagatcttgcgatgaatcgaatttatttaccaaaagaaacgatgcagcggtttgagattaccattcaacacctcagacaaaaaaaggtcactgaatcctttatccagctttgggagtttgaagctctgctagcagaaaaactgtacgatgaagccttgtccatgatgcctcagatcgatgaagactgccaggaagcgcttatggctgctttattgatctatcgcgaactattgacggtcattcgtgagaaaaattaccaggtttttctcaaaaaaaatgctgtctctatccaaagaaaagcttttttattacgttctgtaaaacagcagataaaaaccaaccggagtgaaaataatgcaagatgagattttagacgtggctgaacagttgttcatgcaacaagggtataaaggaacttcaacaagacaaatcgcggagttgttaggcattactcagcctaatttgtattatcatttcaaaagaaaagaagatatttattacggtgttcttgcgcggttagcgatagatgtatctgaaaacttatatcagatcgttaatgatcccaatgactccttagcagagaaactgcaacggatggctcgatttctgcaaaaacgtcaccctttcaatttctacttaatgatggatgatatcaaacataccgtctctgaagaaaccgccagaaaactctacttgatttggaaagaaaactatcagcaaccatttattcgcctttttcaaacaagtgaactacgattacgaaacgaactttcctaccagtttattgtcagccaaatgtttattctcattgcttcatacttagattcagcagagaaagaaactgaactctatcaggccattgatttatttttatatggtgttttagataaagagtctaactagacaaacgtatccactcattcttgattactaaataaggaggaagaatatgccagaatatactgacttgactgcgtctgctgctatcgtcaacgcctttatcacaaaatacaatcagctcaaatcaacttatccagaagcggtgattgaactttgtgacgaccaagggcatcaaatcactgaggtcaaaaaaatcaacagcgaattgatcgaattgatcatcgacgatagccaaggaccaaaatttcgttacatccacccttctcaatttgatttgacattcactgtcaaacaataatccattaggacgatgaaataagatactgctaatgcttctcgcaatgagaagtttcagacacaaaggcatactcaccgttgccttttgagttagctttgatcttatatcactgtcctttttttattgcaattctctttgatagacgaatcgtatctattgacgtaaactaacactgatttactattctgaaaggagcatgttatgtcaaagaaccgaatcgaggcctttacagatgcagtgattgctatcgtgatgactttgctggtcttagaacttcaccaaccaaaaaacgatacctttcaagcgtttctaggcattgaacatcagtttatcatttatttgatcagttttgtgatgctggccatttattggaacaatcatcatcatctcttttaagttgcagaagatattgatggatggacattatgggccaatcatttgctgatactctcgttgtcgctttttccttttgttacttcatgggtcagtcaatacccgctgtccctcgctcctcaaatgctctatggtgctgtgattttcttgactgattttagctattatttgttaggacgagcattaagccgggaaagccaaaataatccaaccattaggaaactatttcaacgctatcagaaattaacctttactctttttgtcaacattgtggcattgctccttggctggttgattcatccgctttttgtgatcagtctcgatagtctcgttctacttctttgggtgattcctgagaagaaagccgaacgctacctgaatcaataatcaatgaaaacgactgcttgatatccccctcgacaatccattcacttgttgttcgtcttcttacctgtcgaataaaacaaaaatcatccaacaaagagcccttttgacggcagtcactgattcgccatcaaacgcactttgttggatgatttattattgtttacgcgtgctttgtatatcctagcgaataatactcaacgaaataaatctaccccaggattctttagcacttgctctacttgttcccgtgtaatcaagggaacatctcctaacatcgtatgggccaatacagcattggtgatagcaaaatccgcggttttttttagtggccatttctcggcatatcctaaaagaatacctgctgcatatgcatcccctgcaccgattcgatctagcacttgtaacaattgaggtgcagtttcaacagtttcttctttagtgtagatcatcccgctgataaactgtttgtcttcactggctatccgtctggttcctgtaaaccattcaatcccgtactgcgccataaaggcctgaacgatttgctgttcctctagtccatcaataggcagctgctcaccaaatcccaaaagaccgtgcaaatctcgtacagacccaaataccaaatcacaataaggcagaatcgcttcgtaacgtttttttaagatttctcgctgtccttcttccaaattcagactgggacgaaaattaaaatcgaaacaaactttgatgttcttcaaagtagcttgttttgccaatgttatcgcggtttgccacgtttcttcggtcaagctcaacgaaataccacaaatatgtaaaagatcgatcgtttctaaatattcagcgatgggataagttgcaggtccggaaaccccaaatgaactaccgcggcggttctgatacgtcacataggtggggcgagcgccaaaaccaacttcagcaaaataactgccgatatgattgtgtgcctgaccaatatattctgtcttgataccataagttcgcaaattcgctttggccgcatcacccaaacggttttttggtactttcgtcaatagggatgctgaaagattgaagtgcgccagatttcctaaaatatttacgcccgttcctgtaaaatccatccgcagcgaatgggtttgttctaatgtccgatattcaggcggtgtcaagcgcagcatgacttcaccgtatgcaccgattcgcatcacaattcctccttcactcttacttcaatgaatctttcatcatcttcagtaatcgtctcacatcttccggacgggtatcgcccgtctctgaatcaatgatcgagctatacacgtgaggaatgattttcttgactcctgcatccacagcaatctgcaagatttctgcaaagttatccaaatcaatcccaccggtcggttcaagataaaagtcatgagctgcacaagcttttgctaccgcttgatattcttctttgtgcgccaatcctttcatagggaaatatttgattgaactagcgcccatatccttgagtaatgcaatcgccgtttcaagaggaacctcagtgggttcttcctgtgaacttaacgggccagtggcaatattgacaaagccgactttgcctgtcggagaaactaatgcattaacaatagtttcttcttgtcctaacaacgcccgagatgttgcagctcccgtgaatacttgattgacatgttgcggctgcaacacagcagaaattcgagagaccatctcgctctgattcggatcaccggcaccgagaccaactgataatgcattttctatttctgcttggtattttttcatgtcttcaatcgctgcttcatccgtggaataatttttggaaagaacgcctaataagattttcccttcggctgcttcaaaacattctttggcgttttccactgagttagctaaaacgtttaaacaaattcgatcttctaaataagtcggggattttttcattcttttggttcctccggattcatgatttcttttaatcgattgacaatcacatgcatttcagtttctgtgactgcccgaatatcaaattcaataatgccgtgatttgcttgatattctctcgtgtagatggctggttcttctacttttaatttctggatcacttccatcgccgatggcccattttggacccgaacccgggcgcgataaatgtctcgccctgcaccatcttggacgatatctgcagacaagccaataatttgattgagcgctgagatgaagggttccaaacgatgcttcatggaagcgccagactcgcttccttcagccagatactcttctactgcttgtgtaagccccatcatattttctttaccgatcttcatggaacgcccgatgcctttggattgcagtctcacccattctattagttctttacgaccgatcactaaaccagcacttggcccagacaaagccttggctccggagtagatcactaaatcggcaccctcctggatgtacctgaaaagatcctcttccgctgccgcatccacgatcaaagggatgcccgactgttttgcgacttgagctgtttcctttactgaaagcatacttttttgtactgtatgatgacttttgatatagagaatcgcagctgtctggggactgatcatctgagcaatatggtcaacagagcacatattggcatagcctgcctcaacaacttggcctccaccttgttgaaccatcacttcaacaggtgtgccataatccacattgtgtcccttcggcaagatgatctctcgacgctgaatcttttctgaataaggatggtaaagatggaatgatgagccttgtccaatgactgctgccacagattgagcaattccagcagaagctgaagagacgatttgagcatcttcaacttgaagtagtttggccaaataggcccctgttttgactgctaactcgctcatctcaaaaaagtgttccccaccaaagcgttgggctgttaagacaccttcgctcactttagaaacaccgagaatcgtcattttaccagaagcattgatgacttgcttcaagccaagtttagtcaggttcaatgtcatatacttgtcctccaattatagtctttagcggaatgatctgtcgatcaatacttcgcttgttcccatttgaatcaatcagtactttggctgcttctttgaattcaaagatcgtgaaatcagcatccatttcttcttcgatcgcaccttttccttttagttgaaactgacgagctggtgccaatgttactttctcgatgatttcttgccaactataaccgacaacggctaatttctccatagtagtagccaaatcatataccggacccttcatacggttacgtatataaatatcggtgctgatagaagcagctttcaaattggcggcataggctttttctgccaccgaaaaattgaaactatctgtaccatgaccaatatcaaaagcaacacctttgccataagcatcaaaaacaaacgatttgatggtatttgactgacgatctaaaataccattttccttgccattgaaacagtgggtcagaacgtcacctttctctaaacaagacaaaatgtcagctaaatctggtggtgctgaaccaatatgaaccatcaatggtaggcctgggtgttctttttggatatttttggctaatttcaatggagtgatgccattttcgccaatcactgtcctgctcattctcgcttttaaccccacgatgaagtcaggaaattcatttagggcctttgtgatcagatcccccttgatcttagaaagatcggctaattcatcttgttcgacgatgccccattttgaaatattgataagcgcaaagacattcgttttggctgcttgtgcaaattcgtagaaacgatggctattttcggcgccagtagtccccgcatcgattactgtcgttacaccttttgccacaccgatctgatcgggataatcatagtacaagctcatttcttcaaaacaatggacatgatcatcaatccagcctgccgaaagatactgattcggaagaagtgtccactccttttgtgcggattcttcgatcgtttttgcgatctggcaaattttcccttgcttgatcccgatatcgaaaatctcttcattgagtgtacgtgcctggcggataatcatatccaacatgttaatcattcctctcggtaaatttaaatttggtccacggatgaatatacgacaacaacagccgttcttcttcgacaattgatccaactttattttttcgcggatcgcaatgaggggtcaacaccacctgtaattcgtttttgtacttgccaaaatcatcgttgccgatcacaatatctccaggttggaattcctccagattatcgtgggctgggttatcaaattgcttgtatttttttcggacttctgttgatcgaatcatccgatcagtaatgtcccctcgacggtaatgctgctctttcagaacgatctttcgttcgcatgaagtgctctccggtgtaaaagtcaccgaaaattctgtttggtaacgattgattgcgccaagtgctgcaagttctgcttctgaggcataggcattcccaatgattacatcatcgatcaatcctgttgcaaaaagatgttttgctgcgatctctacaagtaaatgccgatgcatttctaatgtcggtaatccgtcattgatatcccatggaccgatcgttccagactgtgaagtgataaaagcggcagttcgaattcctttggctttaaaacgctggctgcatttttcgaagaactcatacggtaatgcggtgccttcctgaggataaaaattgtgacagccatataagaaaggcaagtttgcttgatacgtcaaaatattgtctaaataagcgatgtcgttgctcatatttagctcgatcgccaatccaaacggattataagtcagcattgcttctttgctgccgtcaaaacctaaatccaagcggatgccatccgcacccaattcgtggaaaaacgtcaaatcatcataagaaatttccagctcttcaaaaattgccggtgcaacatccaaaatcgtttcgtagccaagtgatttggcaaatcttaataattctgtgaatttcttgcgaacaatttctttcccttctgtcacttctaacatgctcataaaaattcgactaaatccatagcgttgagccaattctaaataagctttgtcttcgtcattactgctgtggtctggataaatagagattcctagttgtcttttcattttgtccactccttctgcgcaccaatttgagaaaattttgtgatcagcaacgtactgcaaccaacagtcagtgttgtcaagatcaccagggcaattgttgtcctgccaaatagcataacggcaatgactaatactaataaggattcggctatcagtgtgcggaagcgaatctgctggataaatgctccatgtctggttagccaaatttgtaatccgataaataataaacatgcatacatcagcatcattttatgcacttagtctcctttcgatcatcaaacgcggatcctcgcgcatgcaccactgtttaagcaacaaatgaaccctaattgcttcactcaaaagaaccatctagaaagcactctgggattgaggtgtttactgggatgatcccgtagaattgtttctgttcacctagaagaactcggtatttcccagagagctcatttggttgtcatttatggatcgttctttgctcctatcccatcgtctcgtttgacttcttgataaagagacccttcattcttgagtcgcttgtccttcttcacgttctaattgctgtttttcaaagactttaaagaatgggtaatagatcgccaatgtaatcaaaaagttcaccacaactaagattccagcggcaacactccaatttgtactcatccaagcagcaatgggtgctggaatggcaaatcctagacgggcagccatcattggaacgatccctgtcgtcgtagcaaagtacgaaattgtcgttgtaatcaaaggtgctacaagaaacggaatcccaagaatcggattcatcacaatcggagccccaaagatgaccggttcattgatattgaaaatacctggcaaaatcgaaagacgtcctaattgtttcaaatagtttgattttgagaataaaaacaagacaaccagcgcaagcgtcgttcctgccccaccaatccaaacaaaccattgcagaaattgttctgtaaagatgtttggtaattcatgcgcattgccggttgattgaaaaacttccatattttctgcaatcgagatatcccagaaaggacggatcaccggacccatgattgctggtccatgaattccaagaacccagaagaaacaaatcaagaaaactgtcaataagccgccaaacaaactgtttcctgctaaaacatctttcagcggcatcaaaaggttacttaagaagccattgatatcaaaaccgatgatatgacgaatgacccaaaacaaaacaagaatcgctcccccgggaatcaatgccatgaaggaattggtcacttcagggggtacaccatcaggcattttgatcgtgatatttttgacaataaagaagcgatagatttccactgacaaaatagctgtgacaattgcaccaaatagtgatccagaaccaaggttagcaacattgatgaaacgtccagcatcgatcacaccttctaccgattcaagaacccgaattggtggtgctgccgtgatcaaaaaggacattgttgccaaaatacctgctgtcaatgagtctagtttgtaactttttgccaatgaagatgcgataccaaaggtcgcataaagtgcaagcagaccaacagtatagcgaaacggaatgtctagaacttcacgatatggttcaataaatgctgcaactgactcaataggaaaattcaataatatcgtgaaaaaggaaccgacgatcgtcaatggtaatgtggcaatgattcctttacgtatggccaccatatgtcgctgcatacctaccttatttgccactggcattaacttttgttcaataaaccctacaaatccattcattttagcgctcctaattataacattataatctttacaaggacaatataacacagttaaaaaggtgtgtaaacgtttttttataggaaataagctttcttcccacaaactgagcgatggaaaaaagcttatgtctttcattgtttgaatgttttttcgtagatatagtcatccattacaaaaccttgaccgatatcaacctttcgttccccgacccggacaaaaccccggtgttcgtagacggcaatcgcttgttgattgccgttattgacgttcaaaaagagtgttttgccagcggctaaagattcaacccaatcaaatactttgctggagacgccttttcctcgcatagcaggtgttaaataaagtttactcaaatacagacggtctgcctcttcttcgtaagctgtgtagccaataatctcatcttctaatcgaagaataaaataagcggcgccttctttgatttcttgttggatcgtttctggagattgataagtttctagcatatagctgacttgagcagacccgatgataggtgtaaagacttctgaccaaatctccttaacgacaagctctaattcttgaatctcctctaaagatcggactggttgaaatgtaattttcatggtggactcctttcaaagatgtatccctacatatctttattatatcggaatgttttttaaataaatagaaaagtctttctttgtcttaactattgataatgttgtctatccgcaattgaaagaaagatttagcagcatcagaaagttctgctgatcgcatcaagtttgttaggaaaaattagatgcgatgacgagaaacaggaccagctcattttctggaacagtttctctttctttcaatttttatccgaaagtgctacccctcattttttcgataagtttttttcattccccaaaaaaatccgagtgtgctatactggttacaagaaaatagagactgccaccgggtagttaaaagaggacgatcattccagtaggtcttagaaggaatggtcttcctctttttgttttctaaataatcaaaaaggagggaaatagaatggcttggctcgaactattattagctggcgtactggaagtattctggtccacaacgatgaaatggagtgaaggatttacaaaaatcaattttacgatttacaccattattggtatgatcgccagttttttctttttgtcgcaagcaatcaaacaactgccaatgagtttctcctaccctatctggactgggatcggtgcggtgggttcagtcatcattggtgtggtattgttccatgacaagataaacccagccacttggctttttgttggattattattgatcagtattgtaggcattaaaatgactagcggtcactaacctcaaaaaagtttttttgaagtcttttaaaagacttttataaaatcgaatcacttctttctaccgaaatctttcttatttctacttttgctttcctctaggatatcatcagactactgatcttctcttacaaaagaaaagttggattaccttcattctttcttttctcaaaggctaaaaaagcagcagtttgatcattgatggatcaaactgctgcttttctttttgtacttgactaaaacgagttgaatctcaaacgagttcagcttttttttctgtaatttgtttctgaagaagagctagtatctgtctatcttctactgataaaatataatttttacaaatttctaaaaggacaggttgtcccacttcattaattttctttgcttgaaggtcagtgatatttatcgtctccatacgatccctactttctttttctgataagaatagtttgccattctttcaataaaaaaagaagcaacgggatgtttacatgctagaaacgtggtgtttacactgttttttttaacttacacaacacaaaatgacccttaaaaataaatcggcgattaatctggttcaatatgaatatctgtatcatagacattgaaacgatcagacagcaatgcttctatggcatcagctactgcatgacttttttcaactgtcaaatatttgtccatcgtaataacaatatcaagaaacacatttgcgccatacattctgccgcgaatactcttgacagattttacttccggaaaatcggctacgacttgttcgtactcgttgaccaatgtttgatcaaaaccatctgacaatgagaaggcactttctttgaaaatatcaatggccgtttttaggatcagaacagcgacaacgatcgctgttagactatcaagccacccccagccaaaagaagcggcaaaaatggcaatggcggttccgatgctggtccaagcatcgctgcgattgtctttggcagcagcaagcagtgcggaactttttacttgtgcagccaatcttcgattaaaggtatacacaccatacatgagaatagccgagaccacacctataattgccgcaagcacatcaggactttctgtctccccttgaatcaaggaccagacagaggaataaagtacttgcagccctacagcaagcatgatcaatgacgtaatcaaacttgctacattctctgctttccaatgtccatacttatgttcttcatcagccggtttttgagctaagcgtagacctatcaaaacagccactgaagcgattatatcggtggcattatttaaaccatctgcccataaagcttccgacccagctattttaccgatcaataatttaacgaatgaaatcaatagataggcgatgatactaagcagagcgcccttttctgctcgcttcaattcttcatatctagtctctctcatttatttccctccagcatcaagataacaacttgaaaataataactgaattcctgaaactttgcagtaattattggagagatataatcttttaggaataacaaacatttgctttctgcgccacgaatgcatcttgcaggtcaaactgaatgaaaaaaaatcagaaggcaccttgttgatttcctttagacatattaaacaagctttaaatcattcattgttcccccgtttaatgaaaaccattgtcactgaatgggagacactatggggtatccttgctgctttgcttagttctcttctatagttctcttctatggttttcttctatggttttcttctatggttttcttctatagttctcttctatagtttccttctaaagaaataagagggaaaaatacgggggaaaatgtgaaaattttctattttggcaaagttttctgttccatttcgaagtgatctcctaagatatggctagaaatgaatctaaagagcagcatctgtctgatttcttaatataatatgatagcagttttctaagacaaaaatgaataaacgatgattatttctagtgaaaaatcaccatttgattttatcaatcgcgggcttcaaggtatactcaaagaaagtaggtgaaaaaatggaatctgaaaagtgttatgccaaaatgcaagatggctcggtcctttactatgagaaaattggaaaaggcaagccattattcttattgcatggcaatggcgggagcagtgcttactttgctaatcagatagctgaattaagtcagaaacatcagctgtacttgatagacagccgtgggcatggcaaatcaacgaatacccgcaaaaaaattgattttttcttgatggctgatgacttgtatgccattattcaaaaagaacacctgtcaaaggtagctcttctaggctttagtgatggcgcaaatttagctatggtgttttgttttaaatatccggaattagtgagttgtctgattttaaattccggcaatacggatcctaaaggggttcggctgtttgcacggatcggcagtctgatccaatatgcagtcgtttggctttgcgcgcctttcgataaaggcatgcgtggttttttaccgattcttgcactactctttcgtaacatcggtttatcagccaccgatttaaaaaaaattactgtcccaacactgattttggtaggaaaaagagattcaatcaaattgtctcattcattttatctagccaatcatattccgaatgccaatttcatggtagtaaagggacaaggacatagttttgctcgcaaaaatccaaatatattcaatcagaaagttctttctttcttagataaggtgggacaataaaatgaaactttttacatggattcgtaaccatctctccttgttcaaaggactctttttgatcgctgtagcagtgatcgttttaggtgaattgctttccttaagcaagacgatttccgtcgatcaattgacgacactgttttccgaattagcggtttggcgtgttgcattgatgcttttgattagtttgctttgtattgcgccaatgattggttatgacattatcttaaatcggctcttaggacaaaagctttctgcccgttatttaagtgaaacaagctggatcatcaataccatgaataatcttgtaggattcggcggttttatcagcattggtcttcgctccgaattctatggcaaagaaaaaaatggcaaagatgttgctcaagcaatttcgaaaatttttatttatctgatgtctgggttatcgcttttatcattactggcattagggttcgtcgtctttgggccaacaactgattatctgcagcaatattggatttggctattgggaggaagtttgtactttccagtggtctatgtcttaagtttgtcgaagaagaatggctatttaggcggtctgaccccttctgaccgcggtcaactgattttggtttcattattggaatgggtaggggtatttacggcctttatcaccaccggtatgctgatggggatctctgtggatatttttcaaatactgccattatttattgctgcatctgtgatagggatcgtatcaatgattcccggagaattaggaacctttgatgtcatgatgatcatgggaatgggttcattgaatattccccgagaaagcgtcgtagcgtggcttctgctattccggctattctattacatcattccgtttttgattggggtgcttttgttctctaaaaatgtcagtgtaacgctcaacacacgcttttctggtattcctaaaggattgcttttagaagtattccataagattgaagtactgttgctctatttgactggtacgatgctggttttgtcagcaacgattccggaagcatttgaccacattcaatggttagcccatcttaatccgatacggttgaattttgtcatgcaatacccaagtattttcttaggctatcttttcatcattgctggtcgtggggtttcagctcgtgtttcgcgcgcttattttccaacattgctgttgattgcagcaacgatcggctatgcggtcttagccggtttccgcttttcaaccatgtgtttcttgctcttcttattggcgattatggtcctttccaaaagtgaactatttcgtaagcaactggtttattcttgggaatggctgacgatcgatggccttttgatgggatctttgactgtcctttatgtgattattggggtctataacatgccccatttaaatcgtcatcccgcccatcgttccattgattttcttttgtttccttctgaaaagttatggttgcaaggctttctggctatcatgatcgtcgctatcgcggtcttgcttttctcacgctatttaatgggacccaaacatcaaattggacagagacctgagaatgaaaaaatcttgactcttttagagacctacggtggtactagtgatagccatcttgtctttttgaaagataaagaagtctatttctatccgaacgagaccgatcctaccgtctttttccagtttacgacctataacaataaatgtttggtcatgggggacccagctggtaagcaagaggattttgctgctgcactagaagcctttatcacagaaatggatcagtggaattatttgcctgtcttctatgaaagcagtgaagaaatggtcatgctgcttcatgaattcggctatgacttcatcaaatttggtgagaaagccttcgtggacctacagaatttcaccttgtctggcaaaaaaatgaagggtcaacgggcattaaacaacaaaatcaataaagaaggctttactttcgatgtcctacaaccaccgtacaatgcggaaacatttgccaagctacgagatatttctgatcgctggctagatggtcgcaaagagaaaggtttctcattaggatttttctctgaagattacttgagcaccgtcccaatcgctgtcgtcaagaaccaacagcaagaaattgtggcatttgcttcttttatgcctacttatcagacaggttgtgggtcaatcgacttaatgcgtcatgatcctgaaaaagcacctaatggcacaatggactttttgttcatcaatctcttcgattattttaaaaaccaaggattcgaacagttcgacttagggatggccccgctggcgaatgtagggacgttcagaagcagtttcattcaagaacggatcgcctatttgatctataactttggttctcacttttattcctttgagggattgcgggagtacaagagcaagtatgcagcttattggtctcctcgttatattctctattccagagatagttggatcggttatgtgatgatcgcattgttgatagtagacaatcgaactattactacgtcttctctttaggataaaaaaagactgcgccacaagtaccaataagacaacaactatccagtaatcaaactattgttcaacaaatcaaaaacgagctccacccatgtttatcaaacaatgggtgaagctcatttatgttggttgattcagttagtttgttattcgctggttttgtctgtttgttcccagagttgtttcacaactggaatattgcctaattctgtcatgtttgatggtagaatgactgtattcgtcttactgttgacaatatctttaaaggcttcaatgcccaagtaagagagtgaacgttcgtctaattgactttctttgattgcttcattgatggctaagatccgtttacgttctgcttcagtaattttagcaattcgttctgcttcggcgtctgcatcgatccgtacacgtttagcacgagcttccgcatcaatctgagtttgttccgctcgggcttgggcatcgatcgtcatttgagaagctttggcttccgcacttaagacagcagaagatttctccccttgtgcccgcgtgatcatggattctttatcccgtgaagcagtgatcagtttgttcattgattcaatgatttcttgcgaaactttgatctcaccaatattgattcggtcgatcgccaacccataccccgctgtgatatctttaatggaagtaaacaacgccacgttgatttcttctgttccgttgagaacttcatttagatccattttcccaatgattcctcgcaaattggattgcgcatcttggatcatagaaacgaccgagttttcattatcataaacaaacgcccggacatctgtgacatggtatttgatggcttcatcaatttgaacgataacattatccttcgtgatagcactttgcggttcaatttctaaaggaatctgtttaagtgatactcgttctctgactgtatataaaatagggactaaaaagtgtagacctggttcaagtgtcttaacatacttcccaaaactctcaactacttttacttcaccttgtcgaacgataacagcagtgcttgccaacagccaaatcgcgatcgctatgacaagaacgattaacataatttgtacgatgatcattgaatataccctcttccattttcaaataatgtattgttcacttgtgtcagcaagatcccattttcaacgccgatgatctccagcatcacattctctgctggaataccggcaacaacccgatattcagtatacgtaccaaagattcgaatgaatccggcataatgatctgtcgtggaacgaaaatatttcccgactgcgcggttttccatatattctacgattttagtcaccctcttcactaactaactatccttagattctgtgctatcatcatatcatgttttaccttgctacacagtaattatttaaacttttactttcaatttaatgtaaaaacaagtaaaaataaaaaaacctgcttttgcaagcaacttaattgctttccacaattaaattgcatacaatctaattgtacaaaatcaaaaaaacaggagtgaagttagatgaaaaaaatgtattctacaaagatgatcaacacaggtggccgttcaggagaagttcatagtcctgatcattccttcgaattatccatcgcagcacctggtaaacgggtcgaaaatgccactaacccagaacaactttttgccgctggttttagtgcttgtttcaacagtgctcttgaacttgtaaagcaaaggaaaggaattgatggcgcatcaactgtaagtgcacaagtttcactttatgccgagaatgaaagtagttttgttttaggagtagagattgaaggattcgtagaaggtctttcattagatgaaacacaagaattactagaaattgctcataccgtatgtccttattcaaaagcaacagccggcaatattgaagtaaccgtcaaagctgttagtgagtagactttccgatacaaaaaagctatgataagaagcgtcagtataaaaaggagtgaggacatgaatgacttagcacttgaaaaccaactatgttttcctctatacgccgcttcgaaagaaattatcaagcattataaaggattactggaccctctggacttgacctatacgcaatatctcgtgatgctcgtcttatgggagcaaggaacattgacagtaaaagaattgggcgattccctgtgtctggactctggaactttgactccggttttaaagaaactcgaaatgaaaggctatctttcaagaactcgcaatcaagaggacgaacgttctttaaatgtgtcattgacaggaaaagggcagctgctccatgattctgcggtgaatattcccagtaaagtcaaagacttcctgccattgtctcctacagaactagctgatttgcatcgcttgacgacaaaaatgctgcatcagtttcagaaaactagctaaaaaagatccgacttaccggattgctcgaaacgttagccgaaaaactaacttcttaagcgcagtccataagtcagatctttttttgttggctctctttggacaagcaagatcactgatggtcttttggcattgaaagctcttgttttttggcagtaattttgtccattaacatcgctaactgcttttcttcgagacgaccaatcgccacctgaagcatagcaaaaatctgatcttgattaagaatcgactgcagtacttctaattcagtcactttgggttgaaaacgacgtgctaaaaccgaaccgctcattttgatgctcgcaacttccagtatgcctttattgactaattttctgatgactgataacgaagtgttgcgattcaagttaaaacgctcactaaaatcactgcaacatagtggttcctgagcattccaaaaacaaatcagaatctcccactctttttttgaaaaattcaaataatccatatatgcccctttctctttgctcattccatgaacaatgttatatagctaatttcctgaatccagtctaactgtaacgctgaattgaaaagacttttcagttattcttcattcatacatcaataataatctatatttaccattttttcaaaatatttttaagattattgaataaactaagcgtaaatttaaacaaataaacagccgaccactgatgctggtcggctgctccttgcgattttaggaaatcatttatttgatattgaagataaggctttcatgttcctgatctttcaaagaataaccgcaagattctttatttaaatgagtataatcggtttcgatcatttggatgatttcttcttctgtcaagaattcatctcttactagaatcaatgagttcaataaaacaaaccgtgaatcatacccaagtatttctggaaaaagttcccaaaaatttgaaccatctatttgttggacagcacatttgaaagaatcaatcaattggtggatgtaagtatataccttagggtactctacttccacaaggtcaagcacctctttatcgatcactttctccaaatagtcggctgtttctttatagagcattaaatcaatcacgcgaattatcaatcctttcatgcggacagttcacagtcaatctactgaaacttcctacgtatatatatatcataaaatcggctaaaattattctcattttgagggaataacgaagaaaaaaatgagaataacatcacaaagtatgagtgaagctgaattatactcaacaaaacaatgattttagctaagaaaaattcgttatatataacggtagtattattaaaaaaaaggaggatttttacggacctgctttaagaatcaaaaaggcccgtaacttataaggcaaacatagccagataatctaagtgtcttgcatctgctatcacaaaaatcacagttatcaggtttgtttgctcttagtcacggacctgcacctattaatgtgcctgatgattgactgaaagagatgatgctgtgctagtagaatgatcattcttagcacgaagtgcagatagaatggatactgtatcgatcacttcttgtaacaaagcgccaaacaacgctgggatcacacccgtgctggcaatcaacattaaaacgatacaaatgaagattcctagcaacacggattggcgggcgattctcatcgtgtcttgagaaatctgtacggcttgagagaccttgctgagatcatcttgtagtattaccgcatctgctgcttccgttgcagcactagtaccatgggctcccatagcaatgcctatatcagctgctgctaaagctggggcatcattgaccccatcccccaccatgatgatcgggcgttcagctggttctgtttcttttataacggcaattttttttgccggcaagcagtctgctagaacggtttcgatccctgcttcagctgcgatcttccgagcaacgaatgcttggtcacctgtcaacatgatcgtctttttcaatccttgatgacgcaactgctcaaccgtttgtttggcttccttgcgtaatgtatcttcaaaaaagatcgttcctatccattggtcatctttcccaacacaaacattggttttagcttcatctacaccaactgctccaacaaattcaggtttaccgattttgatcttgtgtccagcaactgttgcttcgatcccttgccctaccacttctttcaagttggtgactggcagcaaagtcagctttcgttccatagcagaagcaaccagagagcgggcgagaatatgagtggaatcctgctcagcactagccgcaatgcgcaaaagctcttcgaccgatagttgatcagcagtcacagttattttttcaacgtgcaactttccctctgtcaatgtgcctgttttgtcaaaagcgatcgtttttgctttggctaatttttcgatcgtggtgccgtttttcatgacaatcccattgcggcttgagcgactcatgcctgctactaaagctactggtgctgccaagattaatggacaaggtgacgccactactaggacttccgcaaagcggacaggatcttttgatacaaaccaagcaatccccgcaatcacataggctgccaacgtaaatggtacggcatactgatccgctaaacgaacaaagcgcgcaggttttgcttcagattctttgactaaacgaacaagaatttgatattggctatctgctgcttttttcgtcacttcaaaagtaatcgcagtttccccattgactgagccagacatcaattcatcaccaggatttttctctacaggtcgtgactcaccagtcaaggatgattcatcgacaagggtatttccttcagtgacacagccgtctacgggaacgatttctcccgggcggacgatgaccagatcaccaatagctagttcttcaaccggaacatcttttttatcattcagccgatgggcggtctgtggagaacgttgcaacagttgccgaagttctcggctggcttgtttgctggcgtattcttccaaactatcgccgcctgtcagcatgatcaaaaccatcaaactggcccaatattcgccaacagcaagtgtagcaacaatggctgtgatcgctaacagatccacgccatattttcctgaacgcaatgtttggatcatgtcgatcaacatcgtcaacgctgtcaatccgccgatgatcgcgatcaaaccaaaagcaatgggaggtcgatcaaagccaaattcagcgatcaacgccgcagctcctacgccgatggcaatcaaaaatttacttaaacgattcattttatgcacctcacctttcaccaaaagcgtaccacttgcaggaatgaaatgaaacaaaaaaccgttaaatgagaaagagaatcgttaacgtagcaggctttcaagccgttttcaaagttcatccgcctcattgtagataaacctactgctggtgttttaaggtagcacgtcaaatctcccgaatcattcatacccaagaaaatagcctatccgcgttcactgattgctttgcgaggagaacagcgttatctcggacataaacccgttgtccatgtataattgatagtaagagattgatgaaacatcgataaaattgtaaaggagacggatcaaatgaaaaaacactgtaggtgcggaaaaaaactagatggtgctgaaacgaaatgtgctgcttgcaaacaaagcaaaaaacaaaaaatcgagtcacttgagaaatttgtcaagtatggcagttttgccttggccgccctttctttagtactaaaagtagtcaaagatcgggaaagctgagttcttatccttagacagacaaaaaaacgccgaaatggcgtttttttgtctgtctttctgaccaacgtgcattagtctgtgatcgtgctgtctaactgccaattgacttttccttgataggttcctggggaaagggtctctatcttaggggcaaaccgtaaataacaatcatactgacttaaatcgagagagagagctttatcgctaggcgtctgctcaaaaagtacttttttatctgaagtaatggtgcaaaacaatgaattatcagtagaatcgtatagaactagttggacttcatcagccaatgaggcgccactattcataaatggggtggtttgtcccgataatttccatgtaccttcactcgtattgctgattgcgagaggcttgctggttgttgcaattggaacttttattggtaccaagccattagaatccattgctcgagccaactcgttgattgtgactgttgttcctttgaaagattctgggactgattttaattcgatgattcctcgaaaatcaatggcaaagtaatggattgctgatgaattgccttctgtgtcgacgacatatgttgcaaaataataggtagtccctggggaaagatcactcgtctctgactctaaagtgtagtggaagggatctgacaaatctgttcgttcaagaactgtttttagagtaaagtcttcttcctgtaattccttctcttgtgaaaataaatcacttataaataattgcgcctgcgtagaattactatcttccacagagatgtcagtataggcatttcgattttgtcgaaggatcggcgcagttttctgcgcttctgacattgtggcttgtccgctggtcaatgttggtgggaatttgccttttaccgtataaaaatgggtagcggctcctcctgaagtaaaactggatataaaagcatttccactaaaggtagtctcaactggtattacttcatcaatattcgcatctataggggtcccactatacttgaccctaaaatgaacaatataggcattccctttttccaatttcggcaatactacacttatttgtcctgtctctcttatatattcgattggggaccccccatcaggaaaaccgttgatcatggtatcttctggtttaccaaaatagacagtatctttcacagatacattatctggaagtgtgagtttgagtttaatccctggattcaaacttgatagatcgcttgtttgtttaaaatcaatataggttgcataagtaatctctttacttgcatccacttcaattggtttatccattactgttcccgtgtccagcataaactgatctggctctctttggaagacgcccgtccgcatatcaatttcgactagaccttgaacatcgacgaaagcgactgctttgttttgggcaaatccgccattggcaccggtaaaaccaaaataaactggcgccgaatttgttaaattaagattgtttttaaaagtatcatcgacaggaatcgatacatctacattaaaatctggaacagcataatgaaattgttgcgtagattcattgtaatccacgataaaggtatgccaatttccatcggaaatgtccgtaacgccaaccgtgttatagtgatttaagactttatccaccatcagccagccgtctgtcgtataagaagcatcggaaccagggtaagaccaagcaatatggtgtccctttgttgtcacatcacgatccatcatccgatcagtagcaaggataccgccattattgttgtaatatgtatcaaattcaattgcgatactatttgcgattgcaccttgactaagtgggtctgatccagaaatattcgaccaaactccaattgttgatccagcttctgaagctagtgcttgaggcccgctactttgcaacacaaaagccagtccgtcgctatcattagccgtattctcaatatagaaagccatttccaaatggaaatctcgtgtgaaagaagtcggattgttgaaccaaactgccccgctagaatttatggttgtgtcattgatttgaacgtagttatgcccttctacaccttgcaatgaacctgctttacctgcagtagagatcattacttgattaattggtaaagtagcaaagtccggcgcagtgaccgccgcaaagactgtttgctgtccttgcaacagccaaaaagttcctataaaaagaagcgataaacaaaaagattttagcatttttttcattcttctcactcactttcatcggagtttttacgccgcttcactaacaagaaaaggatgattgcaatcaatagaatgattaaagcaatcaatagatagaacagaaaatttctttgagcgatagccgctgcatatatcgtagttcggttgacagcttttgctgcttgacgatcgataacgaccttatcatcaaaaacccatgtgcctcgctgagaggataattcgatgcgaatcgtataagtgcccggtttgagttcttcttgttcaaattcactatagagatctaagacagagttttgtgcgaattgaaaattttctgacttaaagccaccgacgatagcttgattcttgtcacgtatcgtcgtattcacggaaatattcccaaatgcgacgggacgaatattactgatactgctttttaaagttggcttgccatttttttcgactgctttagtttcaactagttttaaatctggctttggcagctcttgtagactttgacgcattcgtacccctaactgcaactgatagtttgattccaaacttgcatcagcttcgtgagcagtttcctgaggtttgacttcttcgaacaaaaaagcccctaagatttctccgtcaaacactttttcctttaaatcaagtgtaaaaatcacctttcgttcctcaccagattttaggcgtacttcttgaatggggtttgaaacaaagctagtaaaagacttacctccatagtcttcggccgttttctttcgttgataactgatgattccagtggaagcagaataactattcagtgcatcagcggtgatcgttatctcttcggaactcgtattgtgtacggcgataatcaattcctgaacagtctctttatttaccagcaaatcgaaataagttgcttcacttgcttgattttggggaagttctggtataacagtaaatctgggggtctcagcataaccactagtcacaggaaaataaacaaagctgataaataaaaagatccatactgcattctgaagaagtcttctcattgtcatccatcctattactgtgcttgataagaattagataatgtccacgtaatcgttcctgtatagtcaccactataaacattttgttggggaacggtcaacgttgtggtcgaaaaatcaaaggtattgattgctaacccagttgcgccatctgcggttgctactgaagtaggatcggtagctccagcaaccaattcagcatttgctgataaagctgcatctcctgctgtttcggtaccttttagtgtaatctttgcatttgctaattctttttgatcggcattcgagatttttgataattttgctgttaattgccaaccaactgtgtttggaccacgaaaatcagaaacagatgacgtttcatttgataccgtggtgatcactttctcttgttgagcgaaatctgcgatattcccagtaccaaaatcaaaatttgaaacactaccaagggacaaaatccctggattgatggttagtgctgcttcactggtcattgaagtagatggatttgcttccgcagctaaaccagtcactgggacccctaaactacttattcctaaaatacctaatgccaacaccatttttttcataagtcattccttcttttttgtttattaaacaagatgccaattttctggcaatactttcattttttcaaccacaaaaaaatgattgtttcttcatcgcctcacattgacttctcatttgtacttagtataatcaaaagtaccaaaaaaacggatcacaaaaccttacaaataggcttcatattgtgcgtaaaaatggagcaaaaaaggagaatactgatgtaccgagagttcatttctcccgcagaggaaaaaaagcttgatatattcaaagcagtatgtaacaccaatggaatcagcttattaaaattatcaagagtattgaaaatccccatcaaaagcttgcaaaaacatatctactttttgaatgaagacttgaaatatctgtccgtcaacctttgtctcgccaaaaattcctacaaccaatattgtatcgaaagaaatggagatagtgccgaaccttcttattcactgctggtctatcattacttgctcagttctccacaatatcaactggttcagtaccttattgggcatacagattcttcaatgtcccagttatgttcggatcttcacgttagccaatctcacatgtatcgtctgataaaaaaagtcagtctaatattaaagaaattttacctctcaatctattccaatgaagaaaatattgtcgaacttgctggaagagagttggatatccgcatctttatttatagttttcttacgcaaagtgcaccaaccgagtttcagcttttatctgatcaatatataacagaattcgagcaattcaacagcttttttgatgctactctcttagatcagttgactaaaaataaattgtttgccttttggaaaacaattaccatccgactttctcaaaagaaatatttgcctgaaatcgagaaaaaagctcaagcactcttgaacttttactcctttttgccgatggaagttctcgattcgttctttttctccaaaactaatttagataaacggatcgctcaagccgaatacttgtatttaaatttctttttgcatattttccttcctgcagttgttgatcgccaaaagattcaagagagtattgcgctggtttaccaatcaaaaaagcctctcgttcatttttttattgatatgatcgaagattggcgacaaaaatttgtgccgactatgaagcaagattcatttgaccaacttctaaacagttgtctcttattttttaatctatcgatttttatcgatgttgatttgctgaaagtttggaatttagactataacttgcccgatgaaagttcgattgacaacaatagtcaaacttatacagcaattgctcacttgttaacagaacatgtcaatacctttccaaacaatgatttagacaaagaattctttcaccgtaaacaattgcgttatcttgcccaactactctatctggaaaccaccatgcatgaaagtccaactattcggatttactttcgaacaacgattcaatatcgaaccaaaatgctgatagaagcccgtatccgatccatctactcagagaagtcggtctcattcactaaagatatcgaaggggcggacttgattattaccgacaattacgaagaagtagcgataacggaaaagcttctgctactctcagatatacttaatatgtatgaatgggaatctttgtttgcaaaaatcaatcaagtaattaccaaaaaaatgtttgccctcacttgcaaatcctcttgttgaaacaaattttttatcatgattccataaaaaaagcgaagctgaaatatcagatgggttccttgctaaagcaatgcaaggcctctgtatttcttacttcgcattttttattgtcgtaagcgttttttaacaacgggttttaagcaaagaagcttccgcctgttacactatagacttgtcctgtgacatagctggcttcatctgacgctaagaaaacataaactggcgctaattcaacgggttggccagcccgttttaataattctttttgtccaaactcagggatcgctgattgtggttgtcctcctgaaatttgtagtggtgtccagattggtcctggtgctacagtattcacgcgaataccttttgaactcaattgtgctgccaatcctttactaaatgaagtgatcgctcctttggttgctgcatagtctaacagatgagcactaggttctgcactttggatggaagtagtggtaatgatactgccgccagccggtaaataatccagggcttcttgaactgtccaatacatggagatgatattcgttgtaaatgtgtccgtgatttgttgggtggtcaaatctttaatatctttgaccgcttgttgcatacctgcattcaagaccaaaatatctaaaccatccaacgctttcgctgcatcatgaaccaactgacgcgcaaaagattcgtctttcaaatcgccaggaatcaatacagctttttgacctgcttcttcgatgatagtcttcacttcttgggcatcttcttcttcaaaaggcaagtagttgatagccacatccgcgccttctttagcaaaggcaatggctgctgcacgaccgatgcctgaatccccgcctgtgactaatgctttgcggcctgctaatcgtcctgaaccattgtagctagtttcaccacaatctggtactggctgcatttttccttggaccgctggtgcttcctgttcctgcttttcaaatgtgccgttatagtacttcgttaatggatcattgattttttttgacatgttcatttcctccttatttttttcatgctcgtcatgtagaaccatgaccttacttaaaagtgtagaggaatgttcatgaaatgaaaaacgaaacgctcacttcatggaaaaatgcgtttttcttgcaatttttgaaaaaaaggaccacgaatccttaaggattcgtggtcctttgatttattttgcggttattgttaatagcgcgtcacggagagcctcataatcagatgctgtttgtaggaacagatctggctgactttggtgactatctaccgtatttgacgactgagtacagttcctttttactcttctttttgtgcggcttatgcgggttgctctttttaaccggttatttattgaatcaccgttctttccaaggattggctcatctattcgatgtttccggtaaactggtgacagacttcgtcacgatttttgcattaggggtcacactgatgaacatggcgatcatggggatgctgctgcttgtattcatctacttgcttgggggccagctatcaggcccattacttggtgctgttctgacagtggttggctttagtgctttcggaaatcactggaaaaatagtctgccgattttgattggggtcgttcttgccacacgtttaggctttaccactgagacttcgacctttcaattgctgttgactgcgatttttggaacaagtttagcaccaatcagcggctactatggaccaattgcaggaatctttgccggtattgcccatgcggcgttagtaagcaatattacctacttacatggcgggttgaatctttataataatggtttttccagtggctttgtggcggcagctatggtacctttgttagatgagatcaaccaaatcaaaaggcggatgaaccaatgatagaaaaggaacaagcacggcggatcgtggatgaagtggtcacctactttctttcccacgactgccctcatatcactactgagatgtctttcgaaaaaacaggttttcgagccattattgctgggacctgtccagaagagcccagtgatttagccgtatttgcggaaatgttgaataccccacgagagattgcgctagaaagttattatattgaacttttaggcgggaaccagtcgattcatgaagaaaaagacttttatttattaggattgttgatcgatgaagcaacaatcagttacgaaaaggatcgcttgatcattacattgtttcgaaaaaaatattgaaggccatgggatctctttgatgaaggaggtcccatggtttttcgtttacaacggtctcttgatacacggaatgcgttgaaaaggtgaacctttggttaacagctcccaatacaaaggagggcatcatgaaattgttttcatgacaaaaatgaaagtttattgataggtttttcacactacaattgtttttacgcccgctataattctctttagactttacaaattaaaggaagtgagaatagatgaagaaattttggatcggcctgggtatcctaatgatcgttttgtttgccgggttacaaattgctgagaaagtcatcatgggcggccaaagttactatgttcagatcacgaccgatggcgaaaagatcgaaaccgaagacgatcgaggcaatcaagtgatcgaatataaatatgaactacctggttacgacaaagacgcaaagaagaaaaatctggaattcttagggatgaaagatcgtcctttgaaaaaagacgcttacttaaaaattacctggaatcaaaacaagggcgtgacttcctatgaagaagtgcaaaagaatgctattcctgaaaaagcgttgaaacaattagaaagtgaacggtgataaacaaatggcaaaaattattgaagcaaacgaattaacgaaagtttacggcaaaaataatgagaaaaaaaccgaagccctaaaagggatcagctttgcgattgataaaggcgagtttattggtattatgggtgcttccggttctggtaaatcaacgttgttgaatattttatccacattggaccatccatcttccggaaacatccgcatcaacgaaaaagatatcacaaaattacgcggtgatgcattggcagattttcgcagtagagaaatcggctttatcttccaagatttcaatctactagaaaatctaacggcttctgaaaacattgctgtgcctctctctttacaaggcgtacggccgaaaaagatcaaacagctcattcaacaagtcgcgaatcgcttatccatcagccaaattttggataaatatccttccgagatctctggtggtcaaaagcaacgggtagccgctgcgcgagcattaatcaccgaaccaacgatcttgtttggggatgagccaacgggtgccttggattcaaaaagtgccaaggatttattagacatgatggatgatttaaacaaaaatgaccaagtatcgatcttactcgtaacacatgatcccctttcggcaagttattgcaagcgaatcttatttatcaaagatggtaagatccatcaagaaatcaaacgaaataatcaaacccaagaagacttttatcgtcagatcttagtcatcttaggaaatctggaacagtaggaggataatggtatgctttggaaattatcacttactggtatcaaaggccgcttaaaagactacatcgtcttgttttctggtctggttatggcttctgccatcttttatatgtttcaatcaatggctagtaatgaagaattcttgaaaaacaattcaacgattggtgtcgttgtcattatctttcactttggaacggtcttactaggaatcatcacatttgcctacattctctatgccaattctttcctaatgtcgatgcggcagaaggattatgccatgtttatgatgttaggagcaaaaggacgaaaaatcgcccaaatgatcttcatcgaaacattttttgtagggattattgcaaccattactggtgctttagcaggtatcggattgacgaaaattgtcaatgatcttttagtacaacagttaaatataaagattactcatttttcgccattcaatgtaaaagcacttgtgatcacactggtcttttttgccattctcttcctgatcgcagcaatcgtcaatgcttcagccattgccaaaaaagccatcttggatttgttgagagaaactagtacacctgcacaaatcaagcaaaaattcccattcttattggttcaaacccttttggggatcatctttcttggaatcggttattatgttatgagcgatctaatgaaatttcaaattatgggtattgcgattgccctagtcacgatcgttttgggaacctatctagttttccgctctgtgatcgtattgattttgacattattaaagaaatcagatgccatcgcactgaaaaaattgaataatttcactttgtctcagttaaacttccgtatccgtgactatacgcagatgctttcgttagtatccatgctgttcgcattagcactgggcgcattaaccgttggccttggtttcagaaatgaaatccctaaaatggccaaagcgatgacctcttatgacttggttctgaataatgcccaaactgtcgaccaacaaaaaattgcggatttacacccaacattgaatgtcagctatcgccaaaaagaggatgacacagccgtttattacattcaagaagaatttgacaaagatcctttgatcgttacagaacagggagatcttagtcagagagatggttaccgctcactaaatggccaagcgatcgcagctgatcttgcagaacaggaccagctgcgcagctttgaattgccagaacagcgagggaaagaagtcaagctgctttctgccaatgcctttgaacaagtgaacgcacccgaaacgatcttacaagtcattcaagtcaaagactttgaagctgtcctgccaaaattaacagcacttgctaagctggatcaaaaaaacaatccatccttagcaggagaaagtaatcttatgcaacgagcggatgcttatgacacattcaacggcattttctcaggatttgaattcatgggcttcttcttaggaattgcctttctaacaatgttagctagttgcttgatgttcaaaatcctttcaggggctaatagtgatattatgcgctacaccatgcttagaaaaatcggtgctcgcaatgggcttctgaaaaaatcgatccgcaaagagatcggcgtgcttttcttagtcccaggattattaggaatcgttcacgtactattcggactgcaaatgtttaaaatgctattgagtgatccctatgatcagatctggttaccatttgcgatctttgttgccctttatgccgtttattatcttttaacggtatggctctacaccaatatcgttttaaaaaataccggaaaacaataagcacccgcaaaatgaacacagtgaaatagacagcaaaaaaccaacgtccagtgtgaactgacattggtttttattttgatctgaagcactcgtctttgttttcgaaaatgagctgattttctcagcaacatccctttaacagcttctatgtcaacacatgctttttattggattcagttggttggtttatatccgagatgcatggctacagtacctccactatagcttttgacaactatattagtcagtcctgctgattgaaagtagtgagacaactcttctttgccaggaaaatctctagctgattcttgcaaccaagaatattcttggtaacttttagcaaacagttttcctaacagcggcataatgaatcggaaatacgcataatacagctgccgccaaccaattaaagtgggctgtgatgtttccagacaaaccacttttccgccaggttttacgacccgctgcatttcttttagaacggttacaagatcaggaacatttctcagaccaaacccgatcgtcacaacatcaaacgtattgtctgcaaaaggaagtgccattgcatttccttgcatccattcgatctttgtcttttgctccgctgcttttttctttgccgcagccaacatattctcactaaaatcaatgccgatcacgttcccagtagatcctgttgcttctgccagtgccaatgtccaatctcctgttccgcagcagacatcaaggatatcattacctgcttggacttgcatccgtttcatcgtatcttttcgccagcgtttatgttgttgaaaagaaatcacagtattcatctggtcatagttctccgcaacacgctcaaaaacgtgatggacacgtgcttccttgcctttgtcgcctatcaacctctacaccatccttttgccttccaatcacgcaacctgcgtaaccaaacgattgaaagctttttccatttactacaaaatttagtgtagcatggatagtcaaaaaagaaaaaattcctgtttaaatctgcatatttctattaacttctctattcttttcgctctcagttttcgtaactcttcaaaccattagtagaattggtggtaacgcagcagaaaggctatatagattcaggaacatttctaaaaaaaagctcctgcgacatggacacatcgcaagagctttctcttatagatcagcaattatttgctttggtccagtttcagcagttactgattttttttctttcttgatttgaagaaaccaagactaccgatcgcaaccagtgcagcaccgatcattgatgcaaaccaagtactttcactgccagtttcggcaagtatttgcctccactattattactattgatgttgttgccaccgctgatgttcccattgccgatgatattgattccaccgttattgccattaccgatattatttcctccggtattgccgccaccagtgttaccaccaccagtgttgccaccgccagtgttaccgtcgtcaactccagcaaccggtactgtgactgtagcagctgcactgcggtattctttgccaccagcaacgacactcgcaacaacatataaattatcttttggttcgacgcgattggctgctactacgatccggtaattgccttcactgtctgtcgtaccagtgcccaccacttctccttgagcattagagatttcaatggttacatttggatcagctttccccgtaaccggatacccagatgattcattgccgctgattgttgcagtaggtgcggcaaccgtcacgggactaacgacgatactcatcggatcactgacatatttcccatcagtttgtgcagtagccgtcaacaaatcttcttccgatagctcggctacattgatacgccaattgccagcttcatccgctcttaattcaagtggtgcggcaaaggcacgggtggtgttcaacccacccagaattcgcgccatcactggtgctgcttcattgatgatcagaatgactgaagaacctggctctgcggttccgctgactgtttcgtccccggcaatcgctggatcaatgagtggcgtagccgttttttccataggtactgtgattggtgtattaccactgcggtagtctttgccaccagcggttacgatcgctgcgacgttcaagttttcttctgggtccacttgatctggcgcgatcacgattcggtaattgccgtcgccatcagtagtaccactacctacgacttctccttgagcattggtgatttcaatgtctgcattcgcagttgttcgaccagctacaggataaccatctctctggttaccagtaattgatgcagttggtgcagaaacacttattccgctgacgatgacactgacaggtgtacttggctctttgtcaccaacagtagagtagctaccacagtcactgtttcgccttcagaaacttccggtacattcgcagtccaatcaccttggtcattcgcaacgaccgtcactggctcttctccgctgacagttaccactacattggcgttcggttcagctgtaccgctgatcgtttgatccccggcattcaccggatcgatcgacggcgtttcagtttggttttcttgtgtatcggctggcacaacaaccggtgttgctccactacgatagtcttgccctccggcagtcacaattgctgtaacattcaagttttcttcaggggcaacttgatctggcgcaaccacaatccgatagttgccctccccatctgcggttccgctgccgacaacaactccctgagcgttcgtgatctcgatcgctgcatgcggtgttgctttcccaatgaccggatagccatctgtttcattgccactaatggaggctgtaggtgctgcaacggtcaaacctgcgacgctcactgtcactggctcgcttggatctttgccatctgcttctgccacaacggtcactgtttccccttgagagacttctggtacctcagctgtccagttgccttgggcatccgccactgctgtgactggctgttcatttccgatagtcactgttactgttgaatctggttctgctgttccgctgatagtggtatcaccagccgcaacaggatcgatggttggtgtttccgtttgttctgctgcaggttctgctgctaaccagatggaattattgccatcctcatctgtaaataaatcaagtgtgagtagattagattgagaaaaagtacctgcaaatcgagcttcgtatggattcgacggattcgtcacaccatttgcaatcagctctgaagtcgttggtgtcgtcacggtcgttggcatcacaactgtcgtttgacctaaaacagatgccgatgcgatttgatcagcaagatctgtcgttccattcaacacagcttgtgcagcatcgacggtaacattcagagtggctttagctgtgttgactgtttcttggacaagtgtattgacgccatcgatcaatgagccaatcccaggaatgttacttgctccgcccaagatgctcacttggatttgcgcctgtttcaagttctccaaaatggattggatgcgttggttgaccacaataaataagccgtcattcacattggcaatcaaggcacgttcattatctgtcaatccagcaggcacttcaaaatcggcttgtccaaattgtcctaactgattcaataaatccaattgttcatagatgtcatctagattgacggatactacttgactgatatcaacgatggaagctgcttgatacaataaatttggaaagccattaatcgtctctggaatccctaatgcatccgctaagttctgattcacaagagcatccaccgttcctaccaatgtgtcaacagcaggcgtaagcgttccaatcagtgtttggatagcggcaatattttcaagttgcagagtgatatttgttgatacccgggcattgccatttggttgtacaaagccagtcagcccttttggcacaccaacgattgctactttatcaccgtttaagacgtcaagcgtcaccgcattcgatccgctgatggtaaagttgactgggttggtatctccaggatttgaatatggcgctgcagcacttgttgcagaatcatttgatgcttggacattactaaaaatctcagcagaaaccaatgatgcttctgcgatctttggtgcccacaacaatgtagtgggaacaaccacagaactcgtcagtaacatcccgctgaccgttaaattcgctagtagcgattttttgtttattgcgcgtctttttctccttgaattcattatttttttatagtcattgcccttcattcttactcctcctattcaagtaaatacaaccaacaaaagtgaccaaccaactttggcattcgtcttttgatgttcgctatgatcacatatccggagaaagagatcacaaacaaaaaacgtttgcaaaataaaaaaacacccattcaaatactcgaaaaaaatctcaattacatttttcaacatgccagaacgatttccgtgcttttttgtgattaaataactaaaatattcagttattcaagcaaattatagcgtttttatttttatacaacaaattattaacaccatgaaaaatttaaaaaaattttattggaaataaaataacaaaaaccttttatttttatcgccatcgttaattatttattacctgtgctcctcttttcgcaaaaaaatcattaaaaagagatttttttgattttactcctttttattaacaaaaattagaaactttttaatgttctcagaatacgcttccatcttttcttctttatttattttgtaaaaaagtgaaataagaattattttctgaacagtattctgttttttttaaatcttttaaaaaaaacagaaaaaaactccttaaaaaaggcgattttcaccgctttctcctttttaaaacaattttcaaacaaataagccaccagaaatcgtgaatgatttctggtggcttagaccattttatgagctacttctaaaggatcaatcttgtaatttcttatgcataaacaacgttgtttctcgatagtcatagaagatttttgagaaggccatcaaatcaccttctcgcaagtaactgtcgtctcgaacaaccaaactagggctccccgcgttcatgccaaaaaaagcagcttgtttagcagtcagtaattcacagcggataaatttatcgatgaaactgacagtcactcccttttcttgtgcaaaatattcaaacatggaaccgtacatagcagattctgggatctgaccaacgatatctgccagataataggatttctcaatcaaatacggctgatcatccagtgtgcgaaatcgttcaacttcaataaaaagctgattatcagaaaatcgctggtggcttggtgaaaaatcgatctcagcgtacgagaccaaacgctgtgttgattgaacggtttgaatcagttttccttctctagcaagatcttcggtaaacccaagatcactttggactgctttttgctcttgcgtcaattgatcatggacataggagcctctgccttgaacttggtaaatatagccgcgtttactcaatctgcttagtgcttgccttaaggaataccgagagacttgatagtgttccatcaattctttctcgctaggcaactttccgttgcgatcagctaaatcctttttttcgattcgtgcgattaaatctgcagctaataaatcgatcgtccattgttttgtcatttcacttctcccccaatgttgtactactcctattttaccgcaaaagctattgccttagtgggaatctttatttctttaatatcatgaagacaaaagaaaacccagctaagacatgtttagctgggttctgctgattcaaacttacactttcggtcaagcttttccttgttcttctgcaaatagtttgccatcatacattttgatgaatgggaaccaaataagaaaagcaaccaaggcgcaaattagcgcaaggacaaatgcacgccaatcgccacctgaaccgataaaccctgaaagaccaattggggttggccaagcgacttgagcaatcggtggtttgacaaaccctaaattgattgcaaaatatgccaccgacatagaagccattggtgccaaaaagaaaggaattgccgtataggggttatacacaacaggcatcccaaacaaaattggttcattaatgttaaagaatgatgggacgatcgcggctttacctaatgcatttagttgtgccgatttagcaaagaaggcgatgaagatcaccatgcccagtgtcgctcctgaaccgccaatggtcacgaaactattattgaattcaccggcaaaagcaatatttgcaccgctttggttttcaaccatgttggaaagaacgatgggcgtcaagaatgaggtcacgatcgttgctccgtggattccgacgatccacaatgcatgcatcaagaaatagatgactaacaacccaacccacgtactcgtcaattgcgaaacaaaactaaagggaatcgcaatgactttgaagatatcggtccctaaagctactaaagcaccgttgatcacgatcacgactaaagcaatcaacgcagtcggaatcaatgcagtaaatgaacttgaaacaccagttggtacagtatcaggcattttgatgtagatatttctcttgacacaaaacgcgtaaattttcactgcaataatagccataataattgcagtaaaaataccagtcgttcctaaacgtgtcacaccacccgccatttcccaaccatcaatgattttttgatcatcggaaataagggtcacaagagtcgctactccgccttcaaatactaattgaggtagacacatgaagaatgccatcattgacaacaaagccccgtttacaggacttaacgaaattttttcttcctgcgcttggatcttggtatattcataaccaaaaacaatacagaaatataaggccaagatccccattgttgcagtatttcctagcatatataaactttggatcttatcaaaagaagccgcccaaatcgatgctaaagctggaaaactttgaggtaagacactaataatcaggaacattgaaccaacgatcgtaaacggaatcgaagccatcccggccgccatcaccccacggacgattcgaaattgcgagattcgccccattggtcccattaagtacttatccagaaaggtaaacattttactattttctgtgttcatctatttttcctcctttattctcaaatgtccgcagatagttcaagtaactatcccgatctttttcgatcaaccatgcttttcgttccatatataaacaacaaatcaatcccagagtcagactaaccagtaaaatcggtctggccgcaagattcaaaaatgggaaaaatccgtcttgccaccctaacaggataaaaaggataccagtaatgttgacccctgtttgaatccaataaccaactttagtcaagtgcaatcgatttgatgtctgccaatatttttgtgtctgttcaaagatgatggcgccatcgaccaaaagcaagaacaccggtaccagacccagcactgtccaatttgccagactaagcaacgcccaataaagattgataaagaaaaaaattgctgtcatatagcgaaaaatcagatagcggttaaatcgcatatttttttgtgcgtacgcattggcaccggacgactgattttgtcctctcatagttatgatccactcctctctcatcatttttatcgcgtataacaaccaaacttgttcgaacaagttaattttagcataaatcaaaaatcatgcaagcgattactttttgatgtttggttgtaaaaaataaactcctgaagaaaatcgtctatattcgcacaactttttaaggactattcaggtatcttccagcaaagttttgctcttgtgaaaacggggattttatgttaaaaatgaataaaaggaatgttgattcaacaagatgttcgcttttcaagttataaaaaaaggtttttggtgtaaaatacttactttaaaaggagaaagacgaaaattatggcaaaagaagtaacctacgaatttatcaaagaaattcccaaagctgaactccatctgcatttagaaggaacattggagcctgatttgaaattacgattggcacaaaaaaatcaaattgatattggtcaatcaacaatcgaagaggtggaagcaagttatcagttcgactccttgccttcttttttgaacatttattatccagcgatgaatgtcctccaaacagaagaagatttttatgaattggcaatggcttacttcaagaaagctgccgaacatcacgtcacttatgctgaagttttttttgatccgcaagcccatacctctcgcggtatttcttttgaaaccgtcatcaacggctattatcgagcgacacaagaaagtgaacaaattggtgtacgaagtgccctaattatgtgcttcttacgggatttttctcctgaatcagcagcagaaaccttagaacaagcactaccttttaaagataagattttggggatcgggcttgattcggatgaaaaaggcaatccaccactgaagttcaaaaaagtttttgaaaaagcaaaagccgctggatttcatttgacgatgcattgcgacattgatcaggaagattcgatcgaacacattcgccaagtcattgaagaaatccaagtggaacgaatcgatcatggaacaaatatcgtagaagatgaacggttagtcgattatgtgcggacgcaccaaatcggattgacgtgttgccctgtctccaacagtttcgtcgtggatgatatgaaaggaaaagaaatcatcgagttattggcaaaaggcgtcaaagtgacgatcaattcagatgacccagcttatttccaaagctatatttctgacgacctttatgcattgagcaaaaattatcagctaacagaggaccaaatcattcaattggtcagaaatgcctttgagattgcttggttaccagaagaagagaagaagttgtatctagcggaagtcgatgcttttgtcgcggagaaaaacaattaatttttattcttatacaggcaaagctgcacaagggtaaaacaaacaatcactccaaatacaggattggagtgattgttttttgcttgttcactaaatatgaagatctttcttacaaaagaccatgcccgatgccacgaacaggatacacgctccaatcaataggacaaagattccgatgagaccactacgatctcctgcgatcaaagcatctggatcaaacaatgtaaagaaagtaaaatactttactttttctgcatttccgccggtgttggcaagcatctgtaagacgtacattaatgctggtatcccaccgccgacagcaatactgtattttgaatcattaaaaacacaagaagctaagaaagagattcctgcgataaacaactgcaaacaaagcaacccaccattcagcagcaacagtttgggaatctcgagttctcctttaaattgtaatccgcaaaggatctctaatgcagtgccatagatgatcaaaaagaaaatacccgttaaaagaaccgacatctgcgtcatgacaatcgttctccgcttgatgggtgctgccagaagggccaccatcgcgttgctgtccacatatttggcaatcaatgcattccctcgaagaatcgagaataccattggaaaaatgatcaaaataaaaccatagaggtaagaagacatgaaacccaataatgagttagcgccggctttcatgccgactgccgacatcaattctggcagcatcttgcgcatttcttcaagagactgcatcatttctggattgtacatactgacaatgattgagatgtagagggtcatgacggcaccaaaaatcacaagcgtcaggatgctgcggcgcaattcgcgtttgtaaagggtgaaattgatcatttctcttcacctccataataatccataaaaatctgttccaatgtttgactcgtactgacttgaacttgactaggttgtgccggatcgatttctccattgaaatctgctgcaaaggctgccgccagttgttcatttggcaaagtgacggtataacgacgcagatgtttttctcttaatgtgtcggtggaatccaacgcaactaattttccggcacgaatgatgccaattcgatcacaggtccgctcaacttcttcaaacatgtggctagacatgaggatggttttgccgcgctttttttcttcagtaattaaatcaataaaacgtgactgcatcaagggatctaagccactagtaggctcatctaaaatcaagatctctgggtcgtgcatgaaagccacaacgatgccaattttttgtttcatccctttactcattttcttgatcttgccgttcggatctaactcaaatcgatcaagtaattctttggcccgtccattttcagcatttccccgatactttgcgataaatttaataaattcgcttccggtcatatcatcaaaaaaagtcatttcgccagggatgtagcctaaatttctttggatttgttctcgttgctgccagcaattcatcccattgatcaaacagttgccgctttgaggtttgatgaaccccattagatgacggatcgttgtggtcttcccagcgccattaggacccagaaaaccaaacgctcctgcttccacagaaaatgacaggtcaaaaattcctttgccattgccataatctcgtgtcagattggaaatatcaattttccccatcattcattcctcctattgaccaacgtctattcactagcaaatcatttgctggtttgcccacttgctttttgatactcccgctttgcaagtgatcagtcaaggccctcagtctttgccatacatatcgtatgatgatagccaaagtatagcctatgttgctgtttttgactaccaaaatatccaccgtattctagaaatagtctgaccaaaaaaagcgcctttttaagtcgcgaattgacgaaaaaaagcggcctcttccattcgaagaccgctttattcgacgattgctgttaatatgatttggaaaaatgacgcttctcattcaattagaacttaaggcaccaaatcatggtcaacataaaaggagtttatcaagtaccaagaaaaactgtcattacctgtcgataatgcgaaaacagtttagacaaaaggtgccttttgttccttgatttcagtttacaaaaagaagctgcacgatacaagaggaacgagtaagaaagctcctgtctgggtccttcacttttattctgactaaatagaacacctattttttgctgcttgtcgtctcctcgtgaataaattgctgccaacgggctctcaacttctgacgataataatagcgagactgttttgatccctcttgattgacccaatcaagccacatttgtcgttctttcggtttcagaaatgcccagaattgcatcagcaatagatgattgtcgatgtcttctttcagatcaatcgtttcttcctgctctgatgcgattgcttgaatcagttgtttttgacgattactttttcgttgtaaatcaatcactcgccatagcaaaaagccaaatagataattcacttcattttcgttgcgaaagatcccttcatcaggataccttcgtgcgcgctcaaagagcatgagtcgcaactcttgcaaataatcttcaaaatctggatgactggggaagatgcccgcccgaatcagcactttgtaaaagaggcgctcataagaagccatcagtgtatgccattctttcattgtattcctccttttgcttggtgttcccgcgggtacattaaccatagcaaaaagaggaagtgactatttttatcaaaaatcaataaatcatttgaattatgcactttttattgcaaaaatagtcagataattttatagttgaagtatctaaaatgaaggagtttttctatgaagagatgctactcccctataagttcgaataaacttgatccttatcgtctgtcctttgagccaaaatgtaaacgattcctcaattctagtgatcaggccacttgccaggaacttgctgctttgatccgtccaaccatgacaattgacttcgagaaagaaatttttgccattctgccttttgttcgtgatgatcgcacgcattctttgatcatttatcaagactattgttcacttcttccacagccgccatttcctatcatcaaacagattcttctccatttccatttttatgagtacgcgcttttcaaagatacactgtaccatttatttagccagtcgaatatcaaacgtcaatacaagattccttgtgcaactagcgaatacagcttgctaccactaacaaacgccaccaaaaaagacaccatttgggtcaatcctggaaaaatcatgacgttgtccgcttctggaccgcagctgttcattgaactgcacaatcagttctcttttcccagctcggttgaatcccgtcgtctaaagcaaaccatgctgatcagttttcttgctcatggcattatcaaacgggaacatagctatcaactgcctcgggcgaatactagcctcactgaatttctggacctttctttttctcctctcaccaatcatttactaggggagcttcattttcacgatctccccggcaaacgaggaagttttagtctgatttatcaagatctctatgcagaagaaagccaacaaaaaatgcgccaaaaatgagtgcatttggccaaattttactcttaccaacgcatttgatccaaaaaggggcaattgcaattaatttaaaagaaaatgcaaaagaaaaaaattttttgatcttttcgcgtattttatttttgagaaacaaaaaggtactagtttaagaaaatagtgctctaagaagatagtgctttaagaaagtagtgctttaagaaaaaattactttaagaaaatagtgctttaagaaaaaattactttaagaaaatagtggcggaatgctgcgaaggaggaaaactagtatgcgtattgttaaaatttcagagacagagatctatgtcgaaatgacagggaaagaatcatttacagttacttgcagcagtgagcagctcgctgagcgatggctagcgttgttagaaggtttagccgagtagagcaactgatcttcgaagcaagatccgcaagcgaaaccgcaagtcagctgaacccattggcagttggctgatgcaatgcctgaaatgcctttcttttctcaaaagaggacagcaagcaatgaccataataaaaagcagcggcaaaaatgaagtgtgtccgaaaagttgacttttggtccaacttttcggatcactgcaagcagccgctgctttttttattagaggcctaattcagacgcagggtcaaagaagcctgaccatagtcctgtcgccattcccaaatgtagatggacaccagtcgaatttccagttgttcccattccaccaaggtattgacgtgctgtgacactttgaccgctactaacagcaggcaatgcattgaagtgcatgtaataactatagatgccattcggatgctttatgatcacataatttcctgtggacggaccataaccggcttctaccactttcccaccttgaatcgcataaatcggtgttccactgctgccggtaaagtcgatcccattgtgctggttgccggaagagcccgttggatctgtacggtatccaaaacgactcgagatatggacagaatcgaccggtaaagaccaaccgcttgtttgtttcccgctggcaagtcccggtgtttctgaattaatttcgggattggtctctttgttgcttgtttcttcaatgctggtctcttctttgattggttcagaagcattcgctgatgtcgttacttctgaaccagtttcatttgcggattctttttcttgagaagctgctgtctcagcgactacctctttttcaacttgttcctgagcttttttttcctccgcttgggcttgtttcttggcttcggctgctaacgcttcttctgccgctaattgtttcaatgtttcttcccgtttcttttcagcagccgctttatctgcttccaagtcagatttcttgctctcttcttgattcagagacagtcgtaagtcggctaatgccacgtactgattcaatcgtacatccgcaagctccccttgcttttgttgcagctcgctcgcatgagtttcaatttcggatagtttttcttctagttctttttcgagcttgatacttgtctcgatgtctttttgctgttgctcaacgatactattgctggcattcatgatggtaacagatgcaatcgctcgttgaattgcttcacctagtgagtccgcatcaagcaatgtcgtcatcatggcattcgaaggttctgaaacttggatctctcgtgcttgattcgccaaagtttctttccgtttagcgattttttcttccaactccttgatgtcacttgcgattttgttgaccttttgctcggtgctagcctttgacgccaaaatcgaatccatttcagattcaagttgttggatctccgcttccgtcttttgtttgaacgcttctattgaagcagattcccttttgatttcattgattcgctgggtttgttgttgaatttgacgatcgacatcctctgcgtttgcaaccaatggaaaacctatcaacatcaacgagcttgcgactatcaatttttccagttttttcatgctatctccttttgaatcctacttttcatttctactagcataccgaatattttgctgcttttgggcagaatcacaggaaaaacatctggatgcaaaattctgacatctcgttgcaatcaacttgttagattcccgcatgaatcgtaaattgctttttgattcttttcagactaaataaatcggaggtttgttacacaaagagatagaggcatgctcactcattgcgcacgcctctatctctgtttgattttcattgaatgatcgacaccacagtcaattgaatcgtccagttgccaaatcagctgcagctactacaatcgcttcttcaggaaaaaccattccggtggtaaaagcattgggatagtcatgttcctactagtgcaaaattactgcaagcgcccgacagccgatccaatcgcattccctgctaacagccatgccttcgctgctttttgtaaggtggtgttttcgggatactttccgacatcgttagaaatagtattgaagacccagagtacgccgtcattctttgctggttctgtcaacagcagttcgtagtcatttccaaacaaaacgaggttggaagacgctggcaaccattctttcaacttgggcgaaagcagccaagtatcggtcacgattggtgctgaaccgtatgcaggaaagtaggtttcaaaaaacattctggctgactgataattttcttggacttgctcatgaaccagtttcgcatctgaagggatgtgaagagaaagataggtttgaccttcaagttgtggtgctttgctcttatgatcagcggcgatcatttcaaattctagctgatcgatcctaaattctaatccgcacaaataccgccatgtccaaaatccacgatcaaacacatcctgattaccggcttgtttcgtttcttttaagaatcgagtaaatgccctcatcgtagccaaataaatctcatgaggaatttgcagcggttgataaatatgtttccagctgatggtcgctgcatacaaatggatcgccaattccttcatcgactcctctttgtacagttgggataaccacttggcttctgctgaagctgttactggatcgagcaatttatgtacactagtaatcatctcttgttcttgcagctcctctaaggctgcgttcactttctcttggactaaaacggggatttcaattaaatccatcaattgctgcaatggctcactgttcgctaacatgttgttcctcctattatcaacctggaattcttcttattgatctatgacatcaaagcttgtttgtaaccgcttcatccaattataaaaagtctagcgcttaaatgatactaaaatataccggtttatattaaaatcctaacccattattgcttcaaagaagatagactcatttgtgcctcctctctaggcatttttttcacgaagaaatccgtcctctatccgaaaaggccctcttacacattccttcaagaatctattcgtaagagagcgccctctataggatagctgaaacagctaacttctggagggcgctacatcgtttttcgataacagttcttgcttgattgtactttcttgatatttcttttttattgcagtaatgacgattgctgaaagtgacagtttttcaaaagtacgatcgacttaatagcaactgctaaatcacctagataggatgtttagcagtatttagttggggctgttttataaatcacagccccagacttcattgttgcgataaatcgctagctcctgaaagcctaatttctccgctgcagttcgttttccatttgctacttcgatcatttccgaaaggatcctttcgccgccttctttgatggacatcttgccagtaatgatcgcagataaatcaagatccatatgttcagacatttgttgatacgtctcatgattaccggtaatcttaaccattggtacgatgggatttccgataggtgtgcccctgcccgttgtaaatacacagatttgggctccgccagccaccatccctgtcacagattcaatgtcgtatccgggagtatccataatgatcacccctttttcagtggcgatctctccatatttgacaacttgattaatcgtggcgtgtcccgctttcatgatggcgcctagtgacttttcttccagtgtcgttaaaccacctttttgattcccgggtgaaggatttgctcctcgaatatctacttggagacgttcaaattgtttttcgagaccgccaatgatagtctgaatatcccgtttaacttgttgatttttggcacgacggatcaagatatgctctgtgccaatcaattctgtcgtttctcctaggatcgatcgaccgcctgcagctaccaaaagttctgtcgcaactcccaaagcaggattgacggataacccactggttgcatcactgccgccacaattggtcgctaaagtaagagcagatagttcaacgggttccctcacaatccgggcagccgcgcctaccagtctttctaataaaggaacgactgtcgcgattgtttttgttgtcccgccttcttcctggatgctaaaagagtagaccggtttgtctgataccttctgaacccgagccaccatttcgtgaggctgaatcgtctcacagcctaacccgacaaagactgccccatagacattgggatttaagacaaatcccgtcaacgttcgtttggtgatttctactgcatctccaatttgaccacagccttttccagctgggataaagaccgtgccggcaattcgttcagccagacggcgtgcagtttcattggcacagcccactgtcgcaatgactaaaattttgttgcggatcccatattgcccatcggatcgtttataacccattattggtttcattagactctgatgctcctcacattatgtgtatgcacatgttcacctttggcaatcgctgctgtagcaatccctatcacttcgccatatttgataatctcttcgccagattcaatatcttttacagaaaatttatggtagctgtcaatagactggacaatcaggaattcatttaaggtcgcttgattaacaatcttcacggatgattccgccggcgttggttgcaaaaccatggcaacattgtcctcgggacgcatcattaatgccgtatacatagactgcctcactttctcttcactcatatttgtcttgaaagacaatcgtgtcgatcgctgcctgacgcaaatgtgcgactaattgtgacaaagacatctgttcacgttgcatgattgcttcaatcactaacggcagattgaacccggcaacgatctgatagtggttagggtcaaaaaattgtgaattataataagcacagttgtaaggcgttgctccaaacatatcaacaaatactaagaccccatgccccctatccagcttgcgactttgatctaaaattttttgacggaaactgtcgacctcttcattttcagcaagtgtgtcgaacgccatctgctgtgtctcaccaatgatcatttgtaacgaatgaacgatcccttggctgagttcgccatgagaaataatttgcataccaatcataccgaccaactcctttcattcaccagaccaaagggttctaagtgcgcaaaaaagcgctcaatattcgtcactacatgatctcccattccggctaaactttcagaagtatacgcaccgatatgaggggtcaatgtgacattttcaaaagccagtaatggatgcgtaggatctaacggttcctgacaaaagacatcggcagcataaccggaaatttcttttctagccaacgcacggatcaaagctgcttcatccaccaattccccacgtgcagtattgatcagcaagacatgctgcttcatttgatcaaaagctgcatcagaaagcatccgctggttttcatctgaaagattgcagtgaagtgtgatgacatccgcttctgacaataattccggcaaagatactttttttccttttgctttgtgaatatcttcagcagacttataaggatcatagactagcacttcagcaccaaagccttcatgcagaatctggccaaccttggagccgatattgccatagccaatcacaccgaccgttgcgtgcttgagttcaaaactattacaactcgaccgcaagtgccactcatcatttttgatcagccgctgccctttattgatcttacgaagttcgttcattaacaaagcaatcgcatgttctgctaccgcttgccgttcgattggccctaaaactttggtcaccagtacctgattttcggttgcagcactaaggtctacattatcgacccctagaccatgacggcaaagcaatcctagatttggtgtattctgaaaaaacgtacgatcgaaagttggcgtgacactagcgataatgcactgatagtccctgagtgcctcagccagttgtgcccctttaatcgttggttcaaacagatgaaagtccacttcaccaaatgcttgcagtcgttggatatgttccggaaaaaacttaccaaaactttttgaattgactactgcaatttttttcatcgacatcccccctagatcgatttcttcgctgcttcgggaaccgtttgcgcataaatcttgatgcccttttcagctgataactgctgcaattgttccaactctgtctcggttagggcaacatttttgataaagaactcggccgattgtctttttggcgtgccgcctagattcaaacaaggtaacggtaaccccaactccaaacacttgatcgctgttgctaccgttttgaacaaagcaaatactttatctgcaccgaattgattggcttcccaagctgccagtacttccgctatgctgtataccttcacttgaaagccgtaacgttttcctgaagccatgtaaatatccatcgaaaaatcatcggaacgcaccgcgtcatcgataatataaatcgtattcgcacccgaagacttggcccactttgtcacgatctgaccatgaatcaagcgactatctactcgagcaaaagtaattttccccatctgtgacaccctctttctgatttataaaattccgatcgctgccagcaatccaacgataacagtcaacaataacatcccttttagtacattcagacccttcttttcaaagtagaagtacaagcccatgaccagtgaaagtggtaagatgcctggcaagatagagtccagaatactctgtaaagcaaattctctttctgacaggacaaaagataatgaagattgaatcgtcacaaaccgtgccgccgtcactcccatcatgaacatcccaaggatcgtcaatgctttcataattaaattggctctcgtcccggcaatcagttctcgagccgcttgccttcctaaccgataactaaagtggacaaacgcacggccatagagatacgttacaacagaaaagacgatccagggaataaccgcaccgaaccacaaaccatctgcagcccaaggcagtgcaattgcaatcagtaaatactgcaacgtgccattattaatggaatccccgatccctgccattggccccatcaatccgacttttgttgcttcgatcaattctgttgaaacggtctgttcagaacctgtttctgccaactctttggcccgctgttcttccagagatgcagtaatcccagaaatggtactgccgccccagatcgcatcagtgttccaaaaggtcaagtgccgattgtaggcatcccgcaagtcttcaggatctttatagatttttttaagcagaggcgtcaatgcatacatcaacgctggtgcgacttgtcgctcataggtgcgagggatctcgttcatccagtaccagcgattccaaatctggttcagttcctttttagtcagtccattgttttcagtcgaagtattctctgcatccatctaggctgcctcctttgcattgatcataatcatggtgtaaatgcctgcagtcacgatacccagtacagcccaagtaaccatggtgattcctaaatctttcaaaataatcgttaagaagaatgccaaaaagaaaaagaacatatcggtcttttgaccaatgatccgaatcaaaatcgcgatcccaacagctgctaacgcactggcgacaacatctagtatatgaaagacaaccgtgccttccaattgtgtcacaacattagctatcgaatctgtcccgaaatataaagcgataaacaataccggcacatgagtcagcatcgtcaatagggttggcaacagaccgattgcaaaagtaaatttcttgtcctccagattattgaccacccgatcaatgtatttggtcacaaaagaattcacgataatttttaatgtatataaataacttcctagaattccgacgggaatcgcgattgctactgccgctgtcggctctagattacccaagatagcgactgctgtagccacagttcccgagacagccggttctgttgccatctggccgcctggcgcaatctgacccatagaaatcaattggatagctgcaccaaccgttaccccttgggcaacatctcccagaacgacaccgacaaataaactcgtcataagcggactaaaccgcaaattcaagcctgcatacccgaagaagcgggcttgaatcaacgccacccaaattgagatgatcaacgcctggatcactgacatattttttcctccgtttctaattctatcaatgccaacagtgaaaaatgaaaggcgaatagaaaccaactcttgctttttacctaggatgaaagcatttcttgatccgccaacaaaagcagcttccaataacgaaacagcgtcccattcccatgaaaaccactcgatcaagaaacagcaaaaaaggcatcagaccagcgtgtccaatgcctttgacatagcgaaataaacctcaggaaaaacgtgaaaatttcaaaaaattgcacaaagcgactagtaatcgctatcaactttcggtaaaataaacacgttggttccttcgggaaacaactatggcaaacttgattggtcagctgtgtaaacttggtgactgatcagggctttctacaggtgcgccaacacccgtagaaagtgcctttttttatttggtttctattccatttcatcatatagaaagcgttaccttttgacaagagggaacatacgttttcgtggagttttttgaggggattttttggggaaagaaaaagaagatatggggtatcttcttaggggtggtgtttttaggctttgagttaataaaagacggttatttggtgactgtcttccctcagtttttcaattttatagggtcaaaatagctttgtagaccaatgtaatacagcgttataaaacaaactaaatctttgacctaaaaaaatgattttagaattgtaataaaaacaattccttacttcaacataaagtgaagtgcttcttgccacgttgggatttcaaagccaattgctttagcttttgacagatccatcactgaatattgtggtcttttggctttttgcggatattgttctgaagtcaccggatttacttcgactgtggtatcttttaatatttctttcgcaaattcataccaagaacaataattgtcattcgataggtggtaaacgccgttaggtgatttttgatcaatcacatatttcataaattctgccaatgttcgtgtccaagttggacgtccaaattgatcattcactacggtcaagctttcatgttctttggccaatcgctgcatcgtataaacaaaattatgaccatattgtccaaaaacccaagaagtacgaatgatatagtaatcactcaatatttcttgaacagcttgttcacccaataatttggttctaccatactcatttagagggtttactggatcatcgacacgatattccccctcttttttcgtcccatcaaaaacatagtcggtactgatgtaaacaagagtagctcccaccgctttagctgcttgagccacatttcgggttccatcgacattgattttttcatcaagtattttcccttcatcctcagcttgatcaacggctgtgtatgcggcacagtggaaaataacattgggcttgatttcttgaacctttctcatagttgcttctgaatccgtaatgtccatttcttgagcatccgttgagacataatcaacacccgtttcatccaataaatggtgtaattcagtacctagctgacccttgccaccagtaattaaatacatctttcttcgcttcctttcgaaaaaagcaggaatcctcctgctttcatcctacagattattgtccttgttgggcataagtttcttcgacttgttctttttctgcttgccaccacgaacgattggttttataccactcaatcgtatccgccaagccctctttaaagttagtaaattctggcgtccagcctaattcttctcttaattttgttgcatcaatggcatagcgcaaatcatgaccaggacgatcattgacatggtcataggcatcctttgattgccccatcaattcaagaatcatttcaatcactgttttattgtcttcttctccgtcggcgccgatcaaatatgtttccccaatggctcctttggtcaaaattgcccagaccgcggaagaatggtcgttagtatgaatccaatcacgcacatttttcccttcgccataaagcttggggcgaatcccacttaatacattggtgatttgtcgagggataaacttctcaatgtgttgataggggccataattattggaacagttagagagtgtagcttgaagtccgaaggaccgaacccatgccttgaccaataaatccgatcccgcttttgtcgacgaataaggactggagggattgtagggggttttatcggtgaacttctcgcctggcccatccccatgacctggtaaatcttcccgcaaaggaagatcgccatacacttcatctgtcgaaacatgatgatagcgaacatggtgtttgcgacaagcttcaatcaatgtgtaagtaccgatcaaattagtctggacaaaaggaaagggatcttttaatgaattgtcgttatgagactcagcggcatagtgaaccaccgcatcggtctgttggaccagctcatcaactaatgccgcatcggcaatatcgcctaccactaattccacacggtcttccggtagtccggctagattttctttgtttcccgcatatgtcaatttatccaaaaccgtcacatgaacatccgattggtgattgaccacataatgaacaaaattggatccgataaaaccagctccgccggtcacaatgattcttttcatttcatgaacactccttaaatttctccgtaaacaaatggattgtcagcttcaaatgcttgtaaggttgggtggtgttgatctttctccgaaagaatcgcttgttctttggcaatcggccaatcaatcgctagttctggatcatcaaatgcaatgccggcatctgcttgtgcattgtaatagttgtcgcatttatacaaaaagttgacattcggtgtcaatgtaacaaagccatgggcaaatccttttggcaccaacaattgacgatggttgctttccgataatatatacccttcccattgaccataggtcggacttccttttcggatatccacaattacatccagcacggctcccgtcacgacacgaatcaatttcgtttgggcagcctctcctttttgaaagtgtaagccccgtaagacgccggcttccactgacaaggaatgattatcttgcacaaacgcatagtctaagcctgcggctttgaaatcttcttgcgaataactttcggtaaagaagccccggtgatcaccaaagactgctggttcaaccaagacaacatcggttaagtttgtttttgtgatacgtaattttcccatttctattcctcacttgctaggtgcaataggtattgaccatattgatttttctttaatggttgcgctaattcaatcagcgcttcacgactaatgtagcccatgcgataagcgatttcttctaaacaagccacttttagattttggcgtttttcaatggtttcaataaatgtcgaagcttctaataatgactcatgggttcccgtatccaaccaggcaaaccctctgcccatcacttccaccgatagttttcctaattcaaggtatctttgattgacatcggtgatctctaactcgccacgttcagaaggagtgatttgtttggcaatctcaaccacctcgttgtcataaaaataaaggcctgttactgcataattggactttggtgctgctggcttttcttcaatcgacacagcttgcatttgctcgtcaaattccaccacgccaaagcgttctggatcagtgacatgatacccaaataccgttgccccttgctctttttgagctgcacgttgcagcattttagataagccgccaccatagtagatattgtcgccgagaatcagacagacactgtcattgccaataaattcttcgccaatcaagaaggcttgcgccaatccatctgggcttggttgtaccgcatattccagatgaatcccaagttcatgaccatcgccaaataattcttgaaagcgcggggtatcttgtggtgtagaaataatcaagatctctttgatccctgctagcatcaatgtagacatgggatagtagatcattggtttatcatagatgggcattaattgtttggatgttgctttggtcagtggatacaggcgtgtacctgaacctcctgctaaaatgattcctttcaaaatgaatcaccaactctagatagaatttgtttttcataatcactatttttaatttcaaaataaagctgcccattatttgactcattgacatacttacctggaatagcttccttatcagaataatttcttgtaaaccactcatattccgtatcaatgtgtccaatgtcaatggcacgaaaaccatgcctacaaatatcttgagacataatacttgctgtaggtcctaatgcaagtaagcacaaataatcttcattatctttgaggaaatctatggcggcattaataattaaatcatatttactaaaggcatttttgctaggagcaataattcttttgattttcccagaatttctaaacaaatcatttccaactcccatcttagttccatctccttcaattattaatagattcttactatcccaaattgatttgattgaattaaaataattattcattttttttgaatctttttcacgatccgccatatataatcttgtaaaattagcagcgccatacgtataagagaaatctaatttttgataccattgatttctattaaataaaagatattttatccaccatttttttgattcatcagttctgaaatttaagttactagaatcaaaaacataaggaacacaaataagaagatcttcttgatttgtatttttaagggctgcttttagttgctctgccattttcttatccaatttttgaaaaccaggggaatgattttgatctattattcccatttcaccatcactgaatctcgaaactgagcattcggattcaattatatagtttatagtttcagtaaaactcaaaactttgggcttttcatgaaaacgttctaaaattagattaattggtatattagcatataacttcgttcttcttagtaaagtaattaaattcatatatttctcctaaacaatacttttctatatataataaaattaatgattaaagctataattacacctgcaaaacctttaataaaaaaatgaatccaatcatttttttcagtaaacactaaattgttaaataaaaaagatgacaagctaattagaataacgctcagaatagatttaaatgtataaatatagaaataattccagcttatatttatatattttgacgaaaatggtattgtatagactattttagttatcacattaacgatactactaacactagctatagcaaaaattccatattcggtatatttaacgaaaacaaatgatactattatacttataatcccagaaaaaacaatattcaaagaattaatttttattttattaacaagtacaaatatatttgtaaggacttctgttccactagaaaaaattgttccaattagagataacaagcaaagaatgaatatcaaacgtatattttgatttggtacccataacgaatagaaattgtagcccaaagaaattattaaggcaataggaatcgttattataaaattagataacgcaattgctttttctaagtaattatgcatcacttccatcttcttatctccgtaatataaagttatttgaggaatgaaaacatttgtcacagtagatgaaagctgagaaattattgttggtaaaacctttgccagagctaatattcccatgctctcaggtcctaaaaatatatttgctattaacaaatctaaacccgttaataacataacccccatttggccaacagaattccaaatccctgagccaactagttcttttaaagttttaatattaaacaatctgaaagaagccttcagaaatggtgttaattttttcttgtaatataacgaaaaaagaacagaaaaaagcgcagcaataaatgaagagaatgcaataaaacttacttttataggaaaaaaataaaataaaattagtatagaagctgctctaataaattgagattgtatattcctcacagactgaatatacaacttattagttaagaaagtagcaatgttccaggaggaagtcaccgtagtaattgaaaaagttaagaacgttattaaaaataataactttatatccttaattaattcgtttggaatctccaaaaaaaagcttatatagttggtaaaaaatatcgaaaatattgttataatcgctccgatgatacaatttcctatggttacatttgaataatacaaattagctcgttcataatttttacttacaaactctaaagtaatgaatctattagccatagagtttagagcaactgatattagtgaagcgtaactaacaaaattattagctaaagtaatatatccatttgcttcaacacctaaatttcttactataaagggagaaacaaatagatttaaagctaaatttattgacagtgcaattattccaaataacaggtttctattattaatatagattaatttgaatttcatattatacaaaaccttttatttcatcagacattttatcaaattcagaacttacttctatttctaattcgcttatttctaaatctaataaatacgctaatttagccaaaatatcttctttcgttgttatttgatctaaaaaaataattgaatttatattcttaatccattcaaaaacccccttaacttttccactactattgtcgaatgcaagacaaggtgtaccagttattgcagcaaatatcataccgtgtagcctgtccgtgataactaactttgatgttttaaattctaagaatttcttatcaagttcttcatttctatcatttatattgatgcgtttattcacaacagtatccgtaaattttacaatatatttattcagaatatcaccatttagtaactcttcaaaatactctttcttactaaaatttcccattttttccttatcatttctgaaacaacataatattttattctctcttttaatatcttcttttttttcatttaagtagagtaccatgtctggaaaataagctacttcatcaaatgactctccaaaattatccaaaactgtcttataagaaactttgtctcttaacataataaatttttttccagaatgtttcttgtatatttctttactcttttctaattcctcgttcccaaaactgctgttttcataaaaaatagtttggggaaaaataataattttattatttttatgtgttcgaaaaatctctctaactaattcttcttctcccatccacaaactacctaaaaatcctcctcctgtaatcaagattatatcttcgtctgaaattaaactgtttatgatctttttattcgataaataaaaagagcttgtaatctcaactatatttttacagatatttttatcttctaaaaacattttttcagctaatgcgatagcgtgatcccccaaattgccatgattgggtgtagataatacaataaattttctatcagaactattacttctgagcttatttagttctttagaatatataagtgaataatatttttgctttacaatgtttttcatttattattcctcactaaccttttaattaataacttcattttctgtttcatagtcaaacttgttccgtaattagttaatttcccacaatatttattagtatagttcatgcttagacaagaagatgtataatatattccttttatacgattaatcaaaaattttttttcttcatccgtgaagttttcactatatttatataaatcatttataataatattgtagtttaaaattgatctctttttattttgagttgtcataatcgaaccttttcggtatctccttttaaagaattgctcgtttatgtagtaaaaattattgcaatttactaataactttggagtaaataattcatcttcatgcaataagttcggtctaaatgaaagattattcatttttaatatctctgccctaaaaatataaagccacactggagcttggtattttttttcaattaaattaagaaaatcactttttccataaaccttttcagtttgataaactttgttggagttatactcatttagatctacattgaaactaggatcatctgaaaatggagtagcatcaaacttaacaagatcaacattcgttttattaaatatttctataaccttctcaaatgtgttataacttatgtaatcatctgaatccagaaaatatatataagttcctttgctgtgtttgattcctgtattccttgctgaagagagaccactattttcttgtgaaataatcctcatactttcaaataacttttggtatttcaataatatatcaagagaattatcactactgccatcattaacagcaatgacttcaaagtttgtaaatgtttggttcaaaagtgaatctaggcattcttccagataattttcaacgttgtacacgggtagtataacacttaaaataggattcatacttaatactccaatcagaatacactacggaatgaaaatggtaatagtttcaaaccggtattattattatttattaataagtaaaatgtaatgaagaggaataatccataacatataaattttattattgaggatatctttttgtcatggattttatttactaagttagcgaataacacaatatatgtgctcgtaaaataaaaagctattcttactgccagatctccaaagttagaaaaacaagtaaccaataaaaaacctatccaaatcagtttaaaccggataaaaatttctttttcctcacctaaattcttataaaaaaacaaagtcattgttatggctatcaatgctaacaagatattaaaatatgataatccaccattcataaatgattgactattattaaggtaaaaagtataaatgccatacttatataaaatattagttattatgttggagcttacaagagctataaagctgataacacctgaactaatgaaaaatatcctatttggtaaaaatttaattacaaaacccgcaaacaaagggataatggctgttgtatgaaatagacaggcaactaaacctaatagtataaacgatctaaatttatctttttcaagaaaactataggcataaaatataattgagatagcaataaactgtctcaatccattcatagaattaaaaaacattcccaatcctaagaacgtccaaaaactgaatattatgtcattagatcgccttattattcccaatgtataaaatgtaataattataatcgtagataacaaaaatattatttgcggattctcaaataaaaacattcctattttatttaaaatataatatccccactcgatatttaaacttttcaaatcattatttccattaattatttgataaaaaatattttcataagtattgtaatctgttccaaccttatacctaaaaccactaactattaccaacggtagataaaacataaaaaaaacgatatatgttttaaagtaatgcgctattcttacttcgttgccaaagcgaagtgaattgataatactacctgtaaaaaaacaaatacataaaaggatatatggggtcaaaatctattcacctacttttttcaacttaataaagtttgaagataagaaaacaaaaagcaaaattacaattcttttttttggtattttagaattaataataaatcttagtccactacgcattcctttttttaattcttttaaaaaatcgccagcatcttctttatatccatatctcaaagctttcaaatacaaagaaaaaaaagaatgatagtatctagttctagcataggaaatataagtcttgtttcctgtatctagtgctaaattatacactgttctgcaattattaatcatacccttatcctgtatttttaaaggactttgagtagagctcttattgttccgatagtaattatatccgatataatctaacttaccatataaattaatatttttgagaatgataaaattaaataaataatcttcacaaaatggctctagtgagaaaaaaacatcttcgattgattcctttcgaaacattttgttacaaactgaataagaactattcggaatttttatacctttatatagatagttttctaagatattgattccacttaaaatatacgaatctgtttttataacattgcttgtatactccattttttgtgtgacttgaaaatcacattctacaacatctaagtgattaagctcaataaattcaattagatattttagataatttttatcaaaccagtcatcggaatcaagaaaacatatatattgtccctgcgctaactttaatcccaagtttctagcactactctgaccagaattatcttgatagtagtatgaaattttaccagaaaacttatccgacattttttctacaatggttctcgatccatctgtcgatccatcatctactactaatacttcataatcttgataatcttgatttaagatggatcctaaagaaaattgaatggttctttcagcattatacattggaataatgatacttattttagccatgtatcttttccttcccagttattcatgaatattttttataagtgcgtcctcaataactttcattctgtcattaaaagcttctattgagaaataagatctaaatacattttttgtattatctaccattgaatagtagtccttttcacttacctcaattattttattaacatctttttttaaattattagacaaattaaatccgcacttattttctttaactaatttagacgtgtctgcatcaatattattaattaaaggcagaccagcttcaaaataatcaatagatttcatagttaatcctacacaaacagattctttcataatattcaatccaaaatgagatttctcaaaaatttctcttttttcttccacatcataaacaataccatagtcattaactgtgatatcaatattttttagttttttaataaattcttctttcttttctccatcaccaataatattaatttcaatatctctttttgatttcatttctttcattaactcacatattttgggaatatcaatgatattgtttatagagcctaaataacaaaaaacaactttagattcaaaagcatgggtcaaatcacccaatgtatttttttcttttgctaaataaagagtttcaacattgcaatctataagctctttatgcaagatatctctatacaggtcacattcacttattattagatcggcaatttttaaataattattccgtctgtttttccaaatatttaaaactggagaaaaatttttcttaaaaggcattgtttcaggccataaatcaattaaatcaaaaacaatttttgttttaggatatttttttttgtatagtaatgcttgttttgcaatcgaattaggtgggattactacgtaaataatatcagttttatttttttttatttttctaaaacttttttttgagaatattagatgtgataacaatcttttaaaagaaatattttttttatatttagggacattaatgaatgaataattcttttttgaaactatcctttttattttctttatatgctggaagtttgatgccacaatttcaacaatgtaacccttactttcaaaataattagcaatcatgtcgattctttgttcgtatgtatcaaaacaattaacaatagtaattttcacttagtcacatccttattcttcatataaataagattcccaaaagctttattaactaatttcccaattcttcctggaaaatatcccaacaaatagatagaccaattcagccatgaaaacaaataaatcttttttccatttgcaagcgcaagatctctaaccatataacttgtcctaacgtagttttcatcttgtggaaaaaaaataccactatctgagttatcaactcttagtttaataaattcacataacctaataatacttagcattgaacgttcattttttatgtttggaaaaattgggagtttattagcaatctttactaattgctgataatttcctttactaccttcaccatagatcataggtggtcgaataattgcgagctgaaaattttcgctttgtaacaaagttaatcttttttcggcctgccatttactgtccccataaaaactagaagggtttggttcagtttcgggtgtaattactcttttcttgttgatatttgtttcttccccatagatgataattgaactcatataaataaactgaccaattcgtccgtttaaatcattcttatacttctgagctgtttcaacagctaaatcacaatttactttataataaagttgtttggtctcttcgcttacttttgaaacatcggcatgagctattccggctacatgaaaaacagaatcatatagtgaaaaatctttttctttccagagttctccatgcatatccaatgtatcaatttgatactcatcaccaaactgcttcatccaattctcaaaagaggtgccaatatagctgttcgcgccagttattaaaatccgtttcattcgacatcttccttctttatggttccagtgccaccttcgacgacaccatcacttttaaatacagaggtaatcgttccaaagaaacatttaacatccatcccaaaactaatatgttctgtatagtacccatcaagcttagctttttcttgtatctctaactcatcacgtccactgatttgagccaatcccgttaatcctggacgaatgtcatttgcctcatatttatctcgttcatcaatcaaatcgtattgattccacaatgctggccgcggaccaatcacggccatatcaccttttagaatattaaaaagctgcggcagttcatctaaactagttttccgcaagaatttcccaacttttgtgataaaaaaatcaggattctctaacaaatgagttggcatttctttcggggtatcaactttcatcgtgcgaaatttgtagatattaaaatgacttttatctttgcctactcgtttttgtttgaatataatcggtccttttgaatctactttgattgccagacacaaaatcaataaaattggtgaaagaatgattatccctattaaggacagcaaaaaatcaattcctcgctttaccctgtctttatacacctgatccactcctatttatttgaagcattggcaaaagcaactacatcttttgctagctgtttgtcatcatcagataattgttcaacgaattccatgacttctgctattgaatagccagtgatattgccaacaaaaattttctcaaacacagcttcatcgtttcgttctttatctaatagcagttcttcatagagtttttccccaggacgaatcccggtctcaataatttctatctcatcttcactataaccgctcaatcggatcatatttttagccaaatcaatgattttgactggctcactcatatctaaaataaagatttctccacctttagccaaagcccctgattgaattaccaatcggctggcttccggaatcgtcataaaatagcgcgtcatgcgaaaatccgtgatggtaattggtccgccatttgcgatttgttccctaaacacgggaatcacacttcctctagaacctaacacattcccaaagcggacagccgaaaatttcgtacatcctgcttcatttaatccggtaacgatcatttcggcgattcgtttcgtcgctcccatgacattcggaggattatttgctttgtctgtagaaaccatgacaaagtttttgactttggctgctttagccgcttctgccacatttttagttccgtagacgttgtttttaacggcttctcttggattgtattccatcaatggcacatgtttgtgggccgcagcatgataaacaatttctggttgataatcttccatgattgcaaagattttcttacggtcttggatgtctgcaatgataggaacgatttccgtaacacactctgagtagttgtttcttaattcgcgatcaattaaatagattgagttttctccgtgacccagtaacaatagcctacgagggttgaagcggatgacttgacgacaaatctctgaaccgattgatcccccggcacctgtcactagaatcgtttttcccgtgatttggtctttgatggcatcaatatccaactgaacttcatctcttcccaatagatcaaccacatcgatttcttttaagcgagaaagattgattttccctgaagcgacttcctccatagatggcatactgtttactttcacatgcaatggctcgatcaattcaaagatctcacgcagttttttgcgggaaagcgaaggaatcgcgatagttatcatagcaatttcatacttatcaactagttctggcaagtctttgatagagccaagcactttcttaccagaaagataggtatgtcttttattgggatcatcatcaatgaacccaacgacattgatatccccggcagtctttgatcctaacaagctattatagagaattcggccaccctcgcctgctcctagaattaaggtgttctttacttcttcactaggtatgcaacggctgtttttcttctcgatgtacaagcgccaaactaatcgactagcaatgataaagaacatcgaaagaaagtacgtagagatcaccagacgcatactataattttccttactgaaaaaaagaagaagaatcgttgtaattgaacttaatgtcagcgctaaaaagatagcaatcatttctcgcagattcgtgtaacgattaattctggaaaagacacgaaaaatccagccaaatagccagtataagacaattgaaagaacaattgaaatttgcataaaatccatcggaatcaaaacaaatggtttcataaaataatacgaagcaatattggcaaaaaccaataatatgctgtccactagaatcaacgtggctatttttcttcttcttgttaattcaaacacctcaaaagccccctaaaataacccaaactttttcttttttattgttgtgtattctggataatcgatttgatccccatttatcaaatctttcgccacttgttgcattaaagttactttgtttggttcaaaatctttggcgatctgctcatacgcttccttcatataaaaagtccgtttattgactccatgagcatctgacgctaccatctgaaccaaattgtgttcaaccattattttcgctgttttttgaatgtctttcccaaagactcccatatagcttggagctgtcaattgtgctaagcatcccatgtctaggaatggaagcaaattattcggatcttttctaaaataggcatttcgctctggatgtacgatgactggtgttttgccaaggctctttagttcaaataagacttgttcggaatatgttggtacttccatggtaggaaattctatcaaaatatacgtatcgtccagatccgtaaataaaatctcatcattacgaatatcctcaattaaatctcctgttatccgtacctcttgtccttctaatacggtcaagggcaaatttcgctggtctaattctgattgcaaagaagagaccaacgaaataacgtcagattttggattgtgatatttcccgttgttgtgatgtggcgtacacaggatgtgagtgattccttgactaatggctttttctgccatcgcaatacttgcttccatcgtttcggcaccatcatcgataccaggtaaaatatgacaatgtaaatcaatcatttcgttcgtctcctaattcattaattcccgtaataatagtaatagcctgaatctttgttattctctgctccgttgtagactacccctaatacgcgagcttgcaccatattcaataattcttttgcctttgttaatggctctttgcgggaaacattttcgcgcacaacgagaatcgtcccatccgctttggacgccatgatctgggcgtccgttactgccactactggcggcatatcaaaaatcacgatgtcatagagtttctttgcttccgccatcacttggttcattctagatgatcccaataattccgaagggtttggtggtttaggaccacttggtaaaatggagagattgtcgatcactgtttgttgggctgcctcagctagattcgttgaagtgctcaaaactgtactaacgcccacattattcagtaaattaaacgttttgtggacggtgggtttccgcatatctgcatccactaacaatactcgttgtcctgattttgcaaaaactactgctaagttcgcagatgtggtcgatttgccttcgcctggtcccgaagaagtgacgactaatgtttttatttgttgatccgctgaagacgcaaattgaatattggttcgaatcgtccgatattgttctgaaataggagaagaaggatccactaaagtgatcagacttactgcatgggtttggatccctttacgttcttgttgtttagccatgtctcttcctcctatactctcgaacggctgcgacgagattccgtcgttttgtcattcgttggtttcttcaaagttggtcttgttggtttcttttggatcgtcgcatttaattctttttgcgacatttgaggtacagtccctaaaatcgtatagccaatcgtatcggtaacaaatttgtcgtcttttacggtacgatctaataattcaaataagaaagcaagtccgacaccgaccatcagccccagcactaatccaatagccaaatttaatttattatttggcgataccggtgatgtgctggcaacagcacttgaaatgatggaaattttgtccacattcatgacgtctttggcattttcctgaaagactagtgctgtggtgttggcaattttttgtgcggttacagcatttggattggttgcttggatcgaaaacatttgggaattttgtgactgattgacggcaatcgcatctttgatctctccagccgtcattttgacattgctttctgattccagacgatctttgacttcgttcaatactaagtcactgacgatcatgtctttatacgtattgatcatttgcagattggtattgacatcattgacatttgcggtttccgattgcggcagtgtcacgatcaattgggcttgtgaactatactttggtgtgatcacaaagaacgttgcaattcctgcaagtgccaagccggcaaacatggcaataatgattgaagccaagtgttttcgcaagacttcaaatatctcttttaagctaattgtttcttccatttcttctccactttcttattcattctcaagatttaattgttctttcagttctgtttgaactcgattcagttcttcctcactaacccgttggtaggaaatgccatcttgcatgaagccttcccctttaagttgatcttgtttgatcgttttgaaagcatcccgataatccaatgcaatcgtccgcatattatcaaaactcatatctgtcttcatattgctttcgacagcactcaagatatcttggtatttgctgacgccatcaaagctcaacactttcttagcaattccctcaacgattttgcgttgtcgttcttgacggccataatcgccattgggatcttcatgccgcatacgggaatacgccaatgcttgatcgccatctagagtgatttttccaatcgtgaaatcataattgtcttgactaaaagtcaggtcgttattgacctcaatgcctcccacggcatctaccaattctttcagaccggccatattgattgagatgtaatgatctactggaatatctaaatatttttgcacggtatccatcgacattgcaggaccaccaaatgcataggcatgattgattttgtctttcgtaccatgaccgacaatgtccacataagtatcccgagcaatactaacgatcgttgtttgttgatcttctggactaaccgtcgctaccatcatcgtatctgaacggccttgatcgacacgtcccaagtccccagtatcgatccccatcaatagaactgaaaaggactcttgtttttttaaatcaacaggattttcccgtttcttttcatcttgtgaacgctccactgattcataggtcttttggatcgaaccggatagatccatgtataacttggcgccgattcctaccacaccgatcacgagcactgcaacgattccaaaaataatcaaaaaaatcttttttccttttgacataattattcctccagttggctcttcctatcaataataggattctgaatctgtctctgaactatccgtcatactatctgaatagccatcaccagtcgttgccgtatctgttgtattaccgtaataaccagcatagcccatttgtgaagcaacggtttctgcaagcttggtatatttttctttcaagtctttattgcgaattttgctgatgctgtcaacggctgataagtagttctcgtaggtcactgcatccgtcactttatcgtctttaagcatacgatcaaattctttttgcagttttgtcacgcgatcaagctgcgcatctgcaaaaccaagatattcttttactaatgctgtccatttgtcttcctcgaaaaaattcaaattttcacgaatgctgccaacgtcggtctctttcagatcttttttgatgatgacgtcattttcggctttctgccaattggagacgcctttcgtgaagagcttgtcggttgcttcttggattttttgctttgcttcgatatccttcaactcatcgtcgatggcttgtttctgcttttggatctctttggcttctgccggcaatgcatcctcttcaatgccgtattcttcgccagatactttgatcatggctagctttccgactagctggctgatatcatccgcggaaatgcccgcttttaaaaatgtatgatcctcattaagataaaggcttgcaacctcttttttcagcgatgcaataccgtcggtctcactggcgatcgcggtttgcgcatattctacccgctgctggtattgtcgctgattgttctggcgatatccaaccaaacagatggcaacggctccaacaccgactgccacaacggtcaaagtcttaagtaacggctttcccatgaacacactccctaaattatttgtgctttataaatttatcttttcaatcaagaaaagcaaatttgctcaattctagttaattataagagaaaattgaaattaaataaaggtaatttaccaagtttttacatcattaagaacaatgtttttgcaaaaattgtgatttaacttgaataaaacagcgatttcttttatataaaaaaacactaaaaactatatattttgttatttaatttctgacgatcaattttttcattaaaagaatttcattctctttttcatctttatttaggcattcgttaaggtgtatcccttgtaataaaactagcatcatgaacagcgagaaaaatcacgattttgtttcttaaaggattcttggatgtttgcaattatttttgagtcttttttcaatctagtaattaaataatttaaatagttgaaaaaaccattttttactcatttaattttctatttttaagtgctcgctttgatctgtttttataaaccaccttatttttcaatattctattctttgaaatgggaaggtgtttgttctttttcatctggttttttgccaataagtgactgcaaaagaatggtttattggcaattcatgtcaattttttcaccgtttgatgaaatacgtgatttgttattgcgattctaacttcattaagatagctatagacagattcaattctttaattggaaaatgaaaggagcaaaccagtgagagagcttcagatgaaattcgttacgaatactgcaacgatccgttggatgcgcattctcgacttatttgagttagagccgctttgctctactcgttcactggcaaaggcttcctcaagtacgacgcgaacgattgtgactgatatcacagacatgaagtcccatttcaaggatgccctccatatcgattcgtcccacaagggttatattttcaccgtattgaacccggcgaagtacctcgcagcgaaacgagcactgattactgacgagattcttttccatattgtcgagagtatttttcagcatgaagaaatgcgttcttcagaatgggcagaaaggtatcatatctctgagagtacggttcttcgttacttgagaaaagtacaacctgttcttcgcgactaccacttgcagctagattataacccaatcacattcattggcgatgaaatggatatccgtaaattttttcatgatttttattatgaatcagaaatcacggcacacacgatctttccccctattgcgattcacgacatcaccgtcaaagctttttctgactgccagcgaaccaacaagcaagcctgctcatttggagagctcaattattatttgtacataacccttgagcgctattgcgggggacacacagtgaaactaccaaaaaaaatcagcaaactgttttcaactaaagaagatttcaaagaatttgcggaaatcaatcagcatatctttgaacactaccaacaaagacttccccaagaagagattctctatctctttctgttggtttggagccggcgttcgattaatgacgttactggtgaggaagtcttctgccaaaaatacaatcagtgggcagaaatcactcagctggccaatgattttgtagctacctgtattcctgaaaccaaaaattcctcccgcgatcatatcttgatcgaatctttttttaccgtagctaaaatcaaacagttgctctcccctttgttgaatcataatattgccgatgtcaatctttacgcccagcgcttgtttcctgagtcttatcaaaaatgtcggaattttctcacagaaaatccattagctgttgctacgtggaataaaaagattttattccatttaagtgccagtctgacgatctatttggaatctatcaaatcgctttattggcataccaaaaaaaatgttgctttcttatttgaaggctcatatattctctgtcagtatttaaaaagcaaatcgatgcattacttgcatagctcaaaaaactttttctttcctgattcaaatgaattgtcacctgattatttaatgatgaatcacattgatctcgtggtaacaaattacacagaatatgtttccgattatgctaatgacattgattgtttgatttttaaaactttccctgacaaaaatgactggaataagctagccaaatgtctcaatcctcatatgaatgcttaagagcacttccgattatgacaggggaagtgctcttaagcgtctattgcttccctaattataagacagcaacgccactgagaacgtatcaatactcttttttctggttctttgatacagtttaggtgtatttaagtcgaatcaaatttgggaggatctttcatggagaaaatcattctgatcggaaatggggatgtaggttcgagttacagttttgcattagtcgctcaagggattggcaatgaaattggtattattgatttagataaggcaaaagcagcgggtgacattcaggatttaaatcatggcttggcatatgttggtccaaaaacactatacgttgctgattatgaggattgtcgagatgcagatcttgtagtgatcaccgctggtgcagcacagctgccccatgaaacacgactggatttgacgaaaaagaatgctcagatcatgaaaaagatcgtgaaatctgttattgctagcggttttcaagggatcttcttgattgctagtaatccagtagatgttttgactcactatgtcaaaaaaatcactggctttcccgctcacaaagtgattggttctggaacttctctcgatagtgcgcgcttgatagtgcgcgcttgcgtaatgcgattggcgagcagttgaccattgatccacgggatattcagatttacgtcttaggggaacatggtgatacccaatttccagtctggtcccatggcaatattggtggcttaagtgttcacgagtggctggaaaaacacccaagtttttcggagcaagatctcggcctgattgcagaaaaagtgaaaaatgccgcttatgacatcattgctgccaaaggttcgacacattatgggatagcaatctcgctggctaggatcacccgcagtattttaaaagatgaacatgcagtactgccggtttctgtacacttagagggacagtatcaagcaaccgatgtctgtattagttcccctgcaatcgtcaatagtcaaggcattcgcgaaattattgaaatgcctctcaatgagtccgagcaacaacaaatgtacgattccatccaaacattgaaaacgatgcaggcacagctgcaggaatgaaacgagcttttctagatgatgcttttacccactaaataaaaaagcgtatcttgtccaccatcaatcatgaatgatggtaggattacaagatacgctttttcgtttattagtctagaatcgttacttttacttgacgtcggccccattgcagacatttggctacattatcaaagtggacatcaatgatatttcctttgatcgcgcctcctgtatctagcgctagcgccacgccatatccttcaacattcaccaaggtacctaatgggatcacacttggatcgactgcgaccgccattggattgctgcgaagatctgttccgctggcagtcaggtggctagcacctttctctgcataagaatatgcggttgattccatgatcattgtcttgccgctggaaggtgtgttgctacccgaattgttggagctgttattcgagttgtttgaactattattcgtcgaactgctgctcgtattgcttgaagctgaattgctgcttgaactgctgtttgattgcgcgctctcacttgaagatgacgactcttgacttgagctttcactcgctgcttttgccgctgccttcgcttctttttctttagcttcttgttcggccgcttctttggctgctctttctttagctgctttttcagcagctatccgagcttcttctgcttctttgctggaagcaatctttgctaaggtcgattcgttttctttcaactgtgtctgcaagttggcgatcttactatccaactcttgcgcctgtgcttccaaagaggattgatcctgctgtaaggattctttggtagactcggctttttcttgcagagactctaatttttctttttcagatgtcaacgagtcgattttttctttttctagattttggagcattgtcatggcgtaagcccggttgatgaaatcttggatattggaagattccaacaagactgtccaatctctggttactccaccgttgacttgaatgtctttcattcgttctgcaactacagcttcacgtttttcaatcgtttcttgagttgcctttatttcttctttggtttgtgccaacgtttcttcattgttagcgatttgtgcttttaatgcttcaacctcgctgtatttattattgacatcggtcaaagcgatttgtacttctgtactgatttgctgactttgctgcataacggcactttctttctctttcaatgattccagagattcagcctgcgcaaagatcggcgaaacgatacctgccgcaaagactgcgacgaccatggtacgtaatttctttgccttcaaaaaaattccctcacttctcactaaggtttccaacgcttattattatacaaattctgggggcaagatatattgcaactcttttacaatttattacaatttttagccaaagtgggagaaataagagtctattaaaaaataattcacgtgaaagtgggaaatcagagccttgaaaaggctttttttattgtaatacttttgtaatattactctctcttcttacgtaattcttccacaaaccgccgtaagtcttgaacattggcaatctcattgatttgcagtttttgaaagttttttaaaagtcttcgctgatgaaaattcagcttcggtaacgtttcacgcaattgctgccaatcgattggcagttcagaaatacgttcctgccaattgtttttcttttgttccaaactttctgataaagtggctttctgctgttcaatagcacggtccagtcgttgaaccgttcgttgaaaagcagcaagattagccaatgtatagcccatatccaacgacatcgccatcaacaatccaacaggtagataaaaactgaatctttcagccaacatttggacaatgatcaacatttgcggatgaacaatgcggacgatcaagacacagcaaatgccccaaaagattgaaattgggacagccacgcgaccattgatattcaaaaaaacattgtggtaatcccaccatgaagcatgaaacagtttttctaataaaaagctcgtcacgtactctaataaggtcactaaaacagctgctgcaaaaaagagcagcagcaattggttatgtaacggtcgcagtaaatacaagacacctaaaattccaaagccataaataggagtgatcggtcctaccaaaaatcctcgataaacaaaatgtctggcttttatcgagcagtaaaccgtttcccacagccaccccacaaaagaatacaagaaaaacagcaaaacgatctgagtaaattcagtcatggaaatctctcctaacgaatggtaaataacttttttggaaaagcattataaaagagcaatataatagtagaaaacttttctttcttattccagtatacgcttcgtttgtcgttaaagaaaagatttgcgttaatctgatcgagtcatctgccctttccaaaaaggatcgagggatgtcctgtatctgttaaattgtaaccgcacaattcttttgtataggtgctatgatctagttcgatattctcgatgatttcttcctctgaaaaaccttggaaatcaaattcgctgatatagcttcgcaaaaggaccaatttggcatcgagtaagatgatttgttgtacacttgtccagaaatcttcctcagattcttcgcgaacaattctttctacttctgcttccgtcacttgccagtaactatggaccaatggcagacgttccttcatcactgcaaaatcaatattcccacgcatctttcgcaaatactctttgacatctggataaaacatccactcacctctgttttctagcatttccctgcttaggagactatcaatggataatcgacagctaacaaaaagttctgattgccaatgacagcacaagtgtacctttccgacaataatcatcctgagcagcgagggatgcattcactttttatatagcatagcaaatgatttgtgggttttataatcaatttttgcatcatgtaaggaaaaatgtgtacaatctcctatactatccagacttagccagcagataaacgaaacttgaatttttaaaattcgataaactactttcaatagtgctcatttagaaagattcttctattgccttatttacgagcttattataggataaataaaataagttttttaaaaaaactagaaggagtaaaaaaatgaaaaagcacatggttttaggtttagttgggtttgggttatttttagcaggatgtacagaaaaaccatcgggattggttgattcttccacaaaagaaaaagagcgtacacaattttcttccactgtaggatcttctgaaacagccagcactggcacttcagaaaatgtgattcctgttgagaagcagacgatcactggtgtaagcggttattcctattcgctggaactgccgacaaattggcaaactgtagccgattttgagtcactaaatccagataatgattttatgctttctgattcgttacaaacaaaatttctggcggctgttgtggagtctaaacaagactttgcagatttcgacagttatcttgcattggttcaagacagtttagcatcgaattttggtaccaacgcgacatttttaccggttcctggtactcaaacccaaatggttgattttgctgcaactgtagaagggttgaacatacattacttatattatgtaacagaaaccgacaataattatgttcaattatatggttggaccttagcaagtctttttgattcctcaaaagatgaactaacaaagatcatggatagtttccaagagagccctcaataaaggcatgattgcagaacagccgttgctttaaactcaaacgaaagaaggagatcaacacaaaaattgtgcggtctccttccttcgtttggaaattttttacatccgattttttctcatatttcttttatctggcagctattcgagtattgccctcttgtgccttcatcattgtactttcatcttaatgtttctatctattgcctattattagggtcatttgctgacgatcaatcgttgtcccataaaaatcaatgagccgctgatattgttccattgcatcagctgattgattgagaccccatagctctgtgcaatcccccataaggtatctcctgattttacggtatatgtcttagaactagaggtactgctgacttctttcacataggcaccactgacccagcctttgccttccacccgataccaggtactattgccattaacactggttccttgtttttgggccactgccttaaaagtcgcattgttggctaatgaccctacgacactagcactggttgaagcatctgaacgaatattcagcgctgccgtggtcttgaattgcttgttgatggtttgctctgaattattgctgttattgttggaccctgcctcagtaacatacgcggcgctgacccagcctttgccttccacccgataccaggtactattgccattaacactggttccttgtttttgggctactgccttaaaagtcgcattgttcgctaatgaccctacgacactagcactagttgatggattggaacggatattcaaaactgccgtggtcttgaattgcttgttgatggtttgctctgaattattgctgttattgttggatcctacttccatcacatacgcagcgctgacccagcctttgccttccacccgataccaagtactgttgccattaacactggttccttgtttttgggccactgctttgaaggtcgtattattggctaatgaccccactacactggcactggttgaagcatctgaacgaatattcagcgctgccatggtcttgaattgcttattgatcgtttgttctgaattattggtgttgttgccattcccgctgccgccaccggtcgcggaatcaaattgtgtcaaattgtaggtttcgatcaaattattcagcttgccggcataagtcgtatctgtcgcataccttccttgaagccattgtgtggcatcacgataggaagaggtattggatttccaagccccactgtaaaaataaacgcctggtgaaaaagaagtcgtttttaagacatgggcattatcttcaaatgattcctttaaagacggatatttgcggaattttgcaacgatctcataaagattgccgttgccatcatcttccattgttcgcatctcaacatattgaccattgtatgaacctttgatcccaaacatattgtttgcttgcgtcgtaagtgtggattgtccccatcctgattcaaggatcgcttgtgctatcatgacggaggcataaagatcgttgacacttgctacttgttgcgccattggtcctacttgctggatgaaggcttgttgtgtattagatcttgccatcacacgatcgatattaggcataatctttgtttctaatgcaattcgctctgcctctgacaacattgggatctcacttgacgattctgcagaatcaacgtcactggcaggctccgttcctagaggttcttctgaagactcgctggttgctgactcatttgatgatactgtggaatctgtgtcctcagtcaacgatgtttcggttccagtatcctcggtggttgttgcttgactcgcttgtgattcatttactaaatcgtgtaaatcggctgtatcatccgacgaagctaccgtagactgttcaaccacttgtacacccgtgtcattcgattcttcaacagaagttgcgagcacactaaccggtactaaattcagcgaactaacgagagcggtagtggtagctgctccttttcggtacaattgactgcgtttttgccgttgcaactctttgtggatctgttttctgcttttcatttttctctccttctactagcgctgattcattctgcccattgggttcaatgagaatcagtccactggatcaagtgtttataaagataaaataattaattgactctaactgcaaagctcggagtgtagtatgctgtattccccacagaaactgtctgtcctggacgaggggcatgaatgtactggttgcctcctaaagagatggcttcatggtgggtactgccggcagcaccccagaacagtaagtcaccagcttgcgcttgactaacagaaatcattgtaccagcagtttcttgcggtactgtccagccaccgatatcttttccggttacttgtaaatagacataacgggtaaatcctgaacagtcaaaactatctggtccttttgctccccagacatacggcttattgagatgattgtaagcttctgctacgatcgcagctccaacgttcccaattggcgcagatggtgtcggaggtgcaggctcagagctaggagcaggctgaggagcaggatttctgctgctttccgtacttgctgccttcgaagaagaatctggagtagttacggggcttgtttcattatttgttggtgtttcttggatatccccttgaacatcagtggattctccttgagcagaacgttcggtttcagaagaatcagcttcagaaatcgaagaattttcagaagactcggtagtcgttggtatgagctgatcttcagctgctgcctgctgtcttgctgcgacccgctctgattcttctcttattcgagtttgttctgcctcataggcttctttttgagcgagcaatgcttccttttcactttctttatttgcttgccgtaaagaaaggtttgtctgcaagacattcagatctgcttgcttggacgccagcttcctttttgggcttccagctggccttgcatttgctgcatttccgccattttggtttctgcttcatttttctttttcttaacagctgcttggtccgcttgttgctgttggatcatctgattattggcattgacgatcgtcgtcattccgtggaaccgctgaacaaagtcaccgaaagattcggaatccaaaagcacggaaataaagcgatcacttttcccattgacttgagtgtctcgtgcttgattctggatcgctacttgtagtttctcgatccgtgcttccaaatcagtcaactctttttctaaatcattgatttcattccctagttttttctgctgagcgattaattcagctgcttgttcattgatgtcagacacttcatttgttaactgatctatttgtgtctgcaccgattgatgctgttgtttcaattcagctacttcgttatttttttgctgaatcaattgatcgtaatcatcggcgaacacggcggttgggatgacaggacttgtcagcgctattgcacaaatgcacaaagatgatgcaagtttctttttcattttctcctccaattcgtcaatttcaatcatcaaattacatttatttgacatttatcattttaacatactcctattcacaacccaattgatttcccgtttacattttcattacaagtgaaatcacttgttttttaattctcgatagtttcttaaaaaacactcaaccttccattatgatcacttttcgaaaagacatctaagttgatgagtttatgaaatcaagcagtatctgtaagatacaaaccgttcttgatttcaaaaagattacaaagccgtagaaaaaaagccgtaaaaaaaagccgtaacaaaagaattcactacaaaaaagtccagagatcgttcgatctcaatcgaacttgagaaaggctatttctccattttttgtattatcttctatcacagcttctaaaaacttttattggtacggcaacagtgttcgcatcacttgaatttgatgatcgatttgttcttcttgaatatgacccgtcaaagctaaaatacccagaccttctataacaaacatatagttttccgcgattgcttccagattccgatcggcaatcacaccttgcgcgaccccaacttgaaaaatctcttggatcgtgcgtttcgtctcagtcaactgcgtttgctgcaacgaactcgtctcaattgacttatgcgtataataatactcatacgtcgctcgcagcatgctgtcggatatgctatgaagcaatcggtatttatgatcctcaaaatatttcgtcaagatagtctcgaaagaagcatttgctttgatcattgctcgaacttcattaaaccgtcgttgcgaacgttgttgcagcacttctaagaaaatcgcatccaccgattgaaagtacagatagatcccgccgcgactgatgccgcattcttcgatgatgtcttgcatcgtcgcatcgatcaatcctttcttgctgaatactactttggcactttccaaaatcgcttctcgtttttgccgttttttttcttcgatcggctttttcatgcttccacctcactttattaatgacacctgtgtcattttattgtataatcatcctaacataaaaatgacacgagtgtcattctataagaaagggtgttttctcatgaacacaaaaaacaaaacgtatcgtttagtgatccgtgcaattctaaccgcaatcattattttacaaacgatggtgcctttccttggctttattcctatcggcatcactagtctgacgatcattcatatcacggtcattgttgctgccattgttttaggaacgaaagatgggatgtttatcggcttggtttgggggattttcacgattattcgggcattcacttcccctacgacccctttggatatcacagtattcactaatccgatcatctcagtcctgccaagggtcttagtaggtctcgtcgctggtatattgtttacttggctctatcgtaaaacaaagaaagtcgtccttgcttcaattgttgcagccatctttggtacccttaccaacacggttctcgtgttaacgttgatgggaaccctgtacactagtttggtggccactacctatggtgttgatgcttctgctttgtttgtcacattaggagctattgcagtgactaacggcgtttctgaagtgatcacagcagtgatcctgacaccaatattagtcaaagcgcttttcgcagccaccagtttacgtccagaaaaccgctgagtaaaagtccgattcttttaggtttgtatcgttagctttatcctatcattttttacgacaagtgcaaacttgtcctctcatttaacaaatgaaatcaacaaaaaaacctctcactagcaacggttccatcatttaatggaacacgtaactgtgagaggtcattttgattatctttcaaaaatcagaaaaaagttgctatcaatgcaaggattgctaaaccgccttgtgtcaatataatttttttgtcactagtgatgctgccatacagagcaactaaaatgatataaatcaaaagcaggcgactcaattcgacaggagaagcggaaagaaacacgctatagagcaagccgatgccgattaacccattatagattccttgatttttgaacaatgtattcagtgaagggcgttctaattcttcttttgataaattgaaaacccgttgcgttctctttgaagtagtcgcaaaagtttccaaatacatgataaatagaaattcaagtgcaacgaacatgattaaacctatagtaatagtggacattttgcttcctccttttttaaatctggttttctttattataaagtaaaccaagcaatcttccgtccttcatgcttctagcgaacacaaagacaaacggaagaccacatagaaagtaagagtagatttatttaaatgtcgtgattttttctgcatccaaacgaatggattcatagcctaattcttcagctttaccaattgatagaatcataactggaacgtagcgttctggatcgacatcaaaagcctctgctaattggtctgcttcaaagccaccaattggattcgtttcgtagccatgggcacgcgcgactaacatcagctgcattgccgctaagctggcgtcaacttttacgatggaggtcatttgatctttcgtgaagctcttgtagtaaggaatgatcgtagccaattgttggtctctgacgtctgccggcatttttcctgcttcaactgcttgattgtaaatttcttccccgtattcataacaagctaaatcaccaaaaatcaagatcatggctgccgatgtgtcgttttggcgtgtgttgaagcggatcagtggttttagttttgctttttgctcagcactttcaacaacaacgaaacgccatggttgcatgttaacagatgagggggcagtcgttgcttcttgaatcatcgttaacatttcctcatgagagattttgaccgtctcatcatagacacggacggattttcttccaaaagtgatagctgaaaaatcgttgtttactctattggttgacatattagtagcctctttcatttcattaatttattcaacaactgcaaaaacgcagctgcttcttcttcggtcagcgatagggcgaatgcttccttctcttggtgtttctcgcaagcagacagctcttgtttggctttaggtgttatttccacaaagacttcacgattgttgtctttgttcctttcccgcactacataattcttttgttctaaaatttttagatgtcttgtaactgctgcactatcgatcttcaattcagtctgtaagtcagattgcgaacaacgtccattttctttgatgaacatcattaattcatatcgggtcagactgaacccggtgcttttttcaaaagttgtcgtcaattcttgattggcaattttcaactgataaagcaggcggctgatttctcttagctgcatggaatactcctctctaacaattgactcatcaatcgttgactcgtcaataataactttttttcttacttttgtaaataatttcctgcgatagacaaaaagcaaacaaaaaaaccaacatcatcgttggttttcttgctgtttttttcacttcaactgaaaggctttttttaatcccattacaaccagtgtggaaagactagccgctaagaaaatgattccccatgtgccaacttgcaatggtgaagtccctaataattcattcatgaaagggagataaacagctgacaactgcaatcccatcgaaaggatcagtgcgccgatcaacggtttattcttgaagaaagacttgtctaatccaaatccgctttgcttgcgaacattaaaaatatgcatcagttgtgcgatcgccataaaggtaaacgtagcggtctgggcataagctaattcatgatttgtttgtatcaaaaaactaaaaaaaccaaatgccgtcaatccgatcactatcccgcttaaaataattcgacctaagaatcgtttattgaccaaactgtcttctttggaacgaggctgacgtttcatcaggtcctcttctgcaggttcaaaggccaacgccatcgcaggagcgatatcgatcactagattcaagaacaaaatatgcagcggttgaatcggcatgggaagaagaaaaatgacacttagaaagattgtcacgatttcgaccatattacaagaaaaaaggaaagaaacgtattttttgatattgtcaaagatgattcttccttctttgattgcgtcgacgatcgtcccaaagcgatcatcagtcaagatcatatcagaagattccttagctacttccgtgccgcgaatgcccatcgcgatcccaatatcggcaccattaagagcaggagcgtcattcacgccatcaccggtcatcgacacgatctctccttcttcccgcagtgctttgactagttgaagtttattttccggcgaaacccgagcaaatacagccacttcttcgatccgttcattaaacgcttctttacctgccaaggcgtcgatctcttttcccgtcatcgtcttatcaaaatcgatcaaaccaatttcttgtgcgatcatggaggcagtttgcgggtgatcacctgtgatcattttgacacgaatccccgcttcttgagcgactttgacagcttctttaacatctgttcgtgggggatcaatgatgccaacaaaaccttggatctctaaattatccaatgattctgtcagctcagactccgacaaaccaccctgatagttactgatttgtgccaccgcaatcactcgttgcccattggaagctagtgtatgattgatgtcgttcaactgctctttcacagacggatcgacggcagctttctcgatcaaaacatccggtgcacctttcatgatcaacgttcgctgttctttttcatagacggtgatcataaatttgttttctgagtcaaaaggaagctcagcgattttttcaatgccttgatccatcagtgtttgacgatcgatgccttctttttttcctaatacaacaaacgctccatcggttggatctcctaggacctcaaactggccatccgtttctttcaaagaagcggacgtacatagtgcaccgttttcaatcatcgcttgaagtgctggctcttcattaactgagatttcttgtccttctttatggaagctccccgtcggttcgtacccattaccggtcacagtgtattgctctccattacttagaatgatctcagcgatcgtcatctgattttctgtcaatgtcccggttttatcactggcaatgatactcgtagcgcccaaagtctcaaccgctgagagggttttgactaatgctttgtgttcagccatgatccgcatgccgcgagaaagagtaatggttgagacagcgggcattgcttctggaatggctgctactgcaaggataatcgagatatgcagcatttctaccaaaggctgatccgttagaagacctgcaattaggaccgtcacggcggcaaagagtgccgcaataatgatagctttccctaatttatccagctcgatatccaaaggcgttttcgcgcttttgtttccagtcagcatatcgctgatttttccgacttccgttttcatcccggtggctgtaacgacggcatagccatttcctcttgtcactgctgttcctgcaaaaacaacattgcggcgatcacctaaagggacgtcttcatcatattgttctgccgcatttttttcgacagcttcggactcgcccgtcaatgcggactcaatacaggctaaattgcggctttccagcaaacgtgcatcggcagcgatcgcatcaccttctgccaaaacgagaatatcccctggaacgatcgcagcagattcgacttccatcacttgcccatcacgaatcacttttgcggtagtgtaaatcatttcctgaagggaatcaattgacttctgtgcacgcaactctgtcacaaaaccagtcatcacggcaattaccaccgcaatcaacacagcaattccttctatcgtttctcccatcgcaaaagagagcaatgcggcggctagtaataaataaacgatcagattatttaaattgtgccataacaatttccaaggggaggtcgattcttgttgctgaatcgtattttcaccataggtatctagcgcctcttttgcgccttgcttactaagccctttcgtctgatctgaatgaaagtattcaagtgtttctgttggtgttcgctgataaaaattttccatctattctcctccttgtataagtatcttctatgtctatagctctgtttttatagtgagattttgtccatgacaaattatggcttcaagtaaagttgtgtcacttgtgcttggagtcagggcgtatgattgacaaaacggaaaaatcaagcaaggattgcttctttcgtatgttgtgagggtgtctgtaatcttgatcgaatgcgaatacagatgggaaaacgcctccacaagttttttacgagttgattggaacacagcaattgaaaatcattggttttagaaagggagatctgggtacttcgtaaaagggtgtctgcagataaggatgtttactttgtgaaaaaaccatctttccatctttaagttatcatggattaaaagacaggtaaattattttgcttgaaaaatatcaatatcattaagataaagaacaaaatttatgtaaatttgaatttaaaataaagagaatcaagatttccgatttcttttcacaaataaatctgatagagcaatccctttccttgtgaaataaataaaaaataacaactttttttaataagaaatttctttcgctcgcgcttttccacctgaatttattcgttttaagtcaacccaattcaatccaagtcaacccagaaaaagaagtgatcctcttgaagaaatcagcttgccgcaagtattcatttgaaatactatgaacgggtttgagagtagcagaagatcatttaaccccagatatttatcatctagaggaaaactaaccactgcttagtaaaaaaaccaattcctttgaggtcttcttcccctcatggaatcggtttttttacctgttcttgctgctgtctttctgtctctaagtaaatatatgtttttttcggagctaataccgtgcgaatttcttgttccaattgatcgatcacctcatagtcactcgaagttgctttaggagaaatcgtcaattcagcaacgatcagtaattcatctggacctaaatgcagagtacgcaggtcaatcacttcagctacttccctagatgataatacttgacgaattttttttagatcacttttcgaagcactctctccgatcaataaactataaaattctttccctaaaaaaccagctacgatcactagaaggaccccaccaatgacgccccctaaagaatcaaagatggggttgttggtgattgctgtcaataaaatacccaccaatgcaatgctcacactgatcaatgcaaacaagtcttctgtaaagcctaaaaggatctcgctctctcggctttctttcaaaaaagcgatcaacggctgtttatccgtgttttgctctttgatttcttgccttccactttggactgctgaactttcaataaaaaaaccagcaaaaagaatggctgcaactagttggatgttctccacttcgtgggtaggatccaaaagatcctgacttgcctccatgattgccaacaggccgccaccgaaaaagaccgtcattgccacaaccgtactaaaaaaatacgtcgcgcgcccctcaccaaattggtaaagttcacttcggccgcgccgtgctcgtttttcgccgattgctagtaatccctgattgagacaatcaatgacactatgaatactttcattcatcaacaccgcactgccgctgaaaagaaatccaatgattttgaccactgctgcaataatatgcgtgactaagacaatccctcgtgcctgtcgtttttcttgatcggcctctttcattttctatgtctccgttctgtccacttttatcaagtgtttccttctgcttatttaagaatagcaccttccaatagaggaggaaaacaattgcgcttagcgctgacgagacccagaaatagaatttaacttttttaatacaaaaaaagagacaagtgagcgttgcattctccttcgaaagctggctacaagtgagaggattgcgacagtaactgtcattctctggcttgtcgttccgagtgaatcgcgttgcttttttgtctctggttgattctgtattcatttgttccatgcttgttcgtgccgagaggcaatggtggtcaagcattggtgatgggcatcgtcgccgctagtcgatatatttttctaaatgatgaatcaactgtgtggcttgctctttagatggcgagagaatcaataatacatcaaagccagccatcgtggcaacaatcccttcaagatccatttcatctagataattcgcaataacatctgccccattgctgacagtatggatcactgtgatgaactccacttgttcaattgatttcaagtattcattcatcgatagcttcagcttttcggtcacatctgcttccgccgtagcaatcatcgtatacttcgttttgccttctttcgtataagtttttgcgatattcaactcccgcatatctcttgaaatggtcgcttgtgtggaacacacgccttgttcgttcaataagcgcatcaattcttcttgtgtctctacttcttggttgaggatcaaacgcttgataatcgcttgtcgctggtttttcttcaaaatgatcacctgcttctactctatccattatctgcggatacgtcatgtatccgcattcaaaaaattatcactgatggacactcgagtcatttaaaagtaagcgagatcgatcatccgtaaatcagctgcttgccacagtagttgtttggaaaatcgatcccaccctttaatgattgtcgtcacagtgcttttattattcatctaattggaaaaacgcatcatcgataaatatcaattctttatattggtaggaaatttttttctgattgatcaattgtttcagcacttgactaaccgtttctctcgtcgtaccgctgaatttcgcaagatcgttgatcatgatcggataaggaatataccaagactcatctagctttccatgctttttcataaggatcgctagtgtattgatgacacgatcatgggcactggaagtaatacagtattgcattctggtcacttgctgttccagtactcgaccttgtttcttaacgatcattttcaataattctcgatccgctaccatcaattgttccaaaacagcagttgccacatacgcgacttcgatctctgtcaccgcaatggcagaaaagtcataacacgctgcttcaaaaaggccatttaccggaaacagttcaccttcactgatgaaatccgtataaaagaaagaatcggtttgatcatttttttcgatacgaatcagtccgctacatagaacaaaaatacgatcacgcaaatctccatcgttgaatagaatctgccctttaggaaaggttcggtaatacatattttcttccaatcgttccctgttttcttgcgtcagcacttttagacaatcaaaattgtcttttacgtattctcgcatgtttccactaatatccatcactccaatactttgtttgccagttaatcagaaatgatacgagtccctgtttcgtgatcaaaatcagctagatcttctaacgaggtaatgatcgcaacattgtttttgctaacctgcacaaaatccatcgctgcttgaacttttggcaacatacttcctggcgcaaagtgaccttcctggatgtattgttccagttctgtcaaattgacttggtctaaccattgctcattgtcttttccatagtttaaggcaattttagagacacctgtcaaaataatcaactcttcagcctccaagacctctgccagtttttctgaagcaaaatctttgtcgatcacggcttcgactccttgtcctgattcagtaacgggtatccctccgccacctgcacaaatgacaataaaatcgttgtcgaccaatgcacgaatgctggcttggtcatggattgtgatcggtttcgggctggcaacgactttgcgccaaccgcgaccggcatcttctttaaagatcgcattggtttctgtcatcatctgctgggcttgctcttcagtcaagaaaggtcctactggttttgtcggatcggcaaatgctggatccttttcactgactactacttgagtgaccagcgttgctacctttgttggtaagccttctgctgctaattcttcttctaatgcattctgcaaccaataaccgatacttccctgagtcatagccacacaggtatctaatggcatcgcaggatttttgggagagtttgctgcttgttgctgtaataagagattcccaacttgcggtccatttccatgggtgatcactacttggatctcttgtttgatcaaagatactaaatgtttggctgtttgtctaagcgcctgttgctgccctcttgcgctaggatcatcggtcaagatcgcatttccacctaatgcgatgactactgttcttttattcgtcatggtatccctcgtcctctcacactcttggaataaatagatttcctaaagtagcggccatgattgctttgatcgaatgcatccgattttcagcctcttcaaattgacggccatatttgctgcggaagacttcatcagtgatctccatttctttgatcccgaattcttcttcgattttctttccgtagacagtattcgtatcatggaaggcaggcaagcaatgtaaaacaatcaagcggtcgtctggtgtacctgtcgctttgatcaaatccatattgatttgatagtcttttagcaaattgacccgttcggtgaacttgtcttcttcacccattgatacccacacgtccgtataaaggacattcgcaccacgaacaccttcagcagtgtcatctgtgatcatcaattggctgccagattctttggcaaattcattggcataacgaacgacatcgtcttctgggaataaggatttaggtgcgcagattcgaacattgaccccaagaatcgcaccagtaactaacaagctattcgccatattgttacggccatctcccacatacaccaacgtgatgtctttcaacgtgccaaagttctctttgatcgtcatgaaatcagcgatcatttgggttggatgccattcatctgttaatccgttccatacaggaacaccagaatacttcgctaaatcttcgacgacttgctggctgaagccgcggaattcgattccgtcaaacatactgcctaacactttcgcggtgtcttcaacagattcttttttacctagctgaatgtcattggcgcccaagaattctgggtgagcacctagatcgatggcagctgtcgtaaaggccgcccgtgtacgagtcgatgttttttcaaagagcaaggcaatattttttccttctaaatagcggtgcgggatattttttttcttgagcccttttaagtgaatcgaaaagtcaatcagatactcgatttcttctttcgtaaaatctttttctgctaataaacttcttccttgaaatacttgttccattattcattcctcctatgataccgttagtctttatttttgtaaatttcaggttgctcaaagatcttctctgataaatggcatgctcatacaacgagggccgccacgtccgcgaacgagttcacttcctgggatgtaattaagtttgacccctgcttcgactagtttttcattcgtaatcaagttccggtcatagacgactacttctcctggtgcaatcgtcaacgtgttcgaaccatcattccattgttctctggcagctgctgtgatatctccacctccgcaacgaatgagttccactgcatctaaatcaagatagcggcaaagaatccgttccaatgtttctttttcttcatagattttgatttggtcattttgtttggagatggaataaaccgttaactcgccttcgatttccggatggatagtgaacttgtcataatccaccattgtaaagaccgtatccaaatgcatgaatttacgctcttcaccgatattgaaagctagcacatgttcaaaagtcggttctttctcaaataattttttcgccaatttttcaattgaagcgacatctgtacgttgcgaaatcccaacagctaacacttttgatgacaagactaattcatcgccaccttcgattcgtgtggattcatcccgattgtataaaagatgctcggcttcttttttgaaaattggatgatagttaaagatatacttgccgtacaatgtttctcttcgtctcgtttctgaatacattcggttcaaggaaacactatttccgatcgtagcaaatggatcgcgggtaaagtacaagttcggcattggatcgatcagaaacggatactgatcgtctacaagatcggtcagattctgatggccagcgatcttcatttcattttttctcaatcctgccatcgttcggtcgatcagttcacgattatcagagatcgatagtaaatattcttcaatcactttgcgggtgttttcactttggatgtttgcttcctgcaagtattctgcaacaaattgttccttgagtcctgtagaggtcaaagattcagctgctaaatcttccaaataaagcacatcaacccctttatttcgcaatgtttcggcaaagaaatcatgttctttttgcgcttgctgtaaaaaaggaatatcatcaaacagcaattgttccaaataatccggcattaaattttccaattcttttcctggacgatgaagcatcacttgttttaatcgtccaatctctgaaaaaacgtgaataggttcattcattttttcatcctcctcattcctatacaatttgtttccctttttctatgaaactttttttaaatagtctgagagtaatctcaaaccagtttctagcgtctctttcttacagcaataacctaagcgggcgtgccctggtaccccaaaagctgttcccggaacaagcaagaccccagtttcttctaatagatccacacagaattgatagtcctcttgttggatcttcaacttgataaatgccgtagaaacataatggggaacgattaattccactttcggttcttggtctacccactgcttgacaatggcaagattctctgcgaccattttcttgtttcgtgcgataatctgctctttgttttccaatacttgaatcgctatttcatcagcgataacaccgccacaaatcatcgtataatctcggtatttacgaaaatgttccgtgagttcttcactagcggcagtccaaccgatacgaatgcctggcgttgagtaggtttttgacaaagagttggtagcaattcccttctcatagcaatcgacgatggaacaaaatgtgccttcttctgttaatggtgcatagacttcgtctactaaaatgtaggcatccgcttctttagcgatggcgacaatctgctgtaattgctcttgatcaaatagcgtaccggtggggttattcgcgttatttaagcagatcatttttgtttcaggtttcactttggctttcaaaactgctagatcaagctgccagtttgcttgatttaattcaacaaagtctacttctgccccaaatgcttttggcaaatcatagagttgctgatacgttggccgcatggagacaacatgatccccgctttcgatcaaagcgaatagtgccaggaaatttgctcctgtagctccgtttgtctgtaaaatattcgctggtgtcatgtgttggtataatgaagcgacgagttctttgaatcgatccgatccttcgatccagccataatctaaaggctgctgcgcgacacgtttcaaaaaatctgtactcgttttgccactgaaggccatgatttcctctagcgtcagtgcttcgatagaactttgggcaatgtcataggttgcttttttctcccagatattcaaccattcctcgacaccaaaattagcaatatccataatcaacccccttatactgagatcattccagtagcgattgctacgatcgacaatactgctgctaaactgaccacagccatgaccattttttgcctattgctgatttgatagttgttctctttacatgcccgtaagtagaaatagaatcctggtaaataggcgatgctgcataagagaacataggcaaagcctgctaatgtgatcccaataatctgaaaggccgttgcgactgcaccaataaacaattgtttattgtctttttgctgataggaataaatcatttgatagatccccacgagcaagtaacaaatcaaaatcgctgcggtacacattgaataagcaaattgatacgcgtaatcggtcacaaggaacgttaacaagaacacgttcgtcaatgcagcagtgataaacaatgaataacttggtgcttgttttcgattgaccttgccccaactttttggcagcatcccatcgcgggacatcaataaggttgtttctactggtaacatcgtccatgacagccagcaaccaatgatggaaatgatcagaccgatattgataaaggctgcaccccactctccaaccatatagcgcaaaatgttggccattgctggttgtggtaacgccatcaattcagcttgcgacatgacgccgtatggcaataaggaagctagcacatagatgactagcaaggaaagcaaaccgatgactgatgctttttgggcatccgaccgtttttccgcacgattggctaaaacacttgccccttcaatcccaacaaagacccacatcatcaccattagacaacctttgatctgtgaccagagactgacagaagcaccactttgtagtgagctgctgacatttccccagaaatctgctgagaaaatatcgacatgaaaactaaccagtgcgataaccataaataaaaacaaaggaactaatttacagatcgtaacaattgtgttgataaatgaagcgctctcaattccgttattcaccagaaaggtcaatacccaaataaaaacacttgctagtaagattgacggaatgttttgtcctcccttgaatgcgggtataaattcaccaattgcactcatgagcattgtcgcaaaggcgacgtttcccagccaggcagagagccaatagccccagccactgataaaacctcctaatttcccaaatgccgcttctgcatacccaaaaataccgccgtctaaatctggtcgtttggcgcctaaattattcaatgataaaactaatgcaagaatgccaattccgacgatgatccaggcgatgattgcaggtccaggagcagcggacatcgctaagtcattcgtgataccgaagattccactaccaatggatgaactgactactaaggcaatcaagccgattttactgattcctcttttcttttccattgttctccaactttctttagtattgtgtagtaacttgcataaatcccacttgcaaaaaaaatcacaaaaagcattaaaaccaatctagctaaatgaaatactctctcgcctctttccttttatttattgattttttcagctgaaatcaatcactcttcttcctgataaataacaattatttatcaggtacatgtatatgataacgagttaaaaacgcttacattgtggttcagttatcatttccaatgccaaaaaattggcattattcatccgtaatgaataatcgcttttatcctctttttttacccatttttttctcctctagctcataatcattcagatatttttttctaagaatttcattagaaaaattgaatagtgtctattttttgaagaaaatcaatcaatttcgagcgaaagaaaaaagcagcacactactcaaacattcatgcatttaatgtatacggccccttacaagcgctcttacggggacaaaaaaaagaaacgccgcagcgtttctttttttattatttcctattataaaagaacatcatttcattaatagttggtacttgtctccgtagtcgtcccttgattttctggtgtcatttcatctgatctacccaatgcttttagcatatcattacggatctcattataggagtaatcttgaatataaacgattgattggccatcataagattcaccatcataccattcataagtatgtttatcgatagtaaaaccagaaagcatattcccagctagtgaaaccaagtcttcaaacttaaagttggtattgacattgtcactgacagagtcaagaatctcctgatattttgtgacattattgattttcaatgcttgactaatggctgcttcaatgacttcttgctgtcgattgccacggtccacgtcagtatccattttacggattcgagcaaaaatcaatgcttgctctccattcaacgactgtcggccctttggaatcagtgttttaccagaattgtccgaagtatacttttcattaatgtcataaggaacatctacggtaacaccgccgattgcatcaatgatcttctcaaaacttgtaaaattgatattgacataataatcaattggcaagttcaaatagttttgcaccgtttcaatcgttgcatcttcctcaccaatcgcaaatgcactattgatttttgccgtgttgacgaccgtcccgtttccggtaccatcgtagatatttgtccaaatatctcgaggtaaactcaccatgtcgatctttttattttcgccatcatagaccatatagatcaaactgtctgctcgagtcgtatccagatgctctttcttttctcgttcggcatcattgtcgacccccattaacaggatcccaaatttagaatcaacatttgctgatttcaatgaattgtctttttctttattggatttgatcacagcggattctttaaacattttatccacagaattttttgcagcataatacgtatatcctgcaaataaaaagactcctgcaatcgcaaaaagtacgacgcctcctatgattcggcgcttattacgagctttgcgggcccgctgtttgctaaatttcgactttctatccatagtgcctccttcatgtttcctacttcactctccccgattgtaccagattttgttttcagcgcctatttttttaagatattttatatttttgctgtgaatttttatgctaatgcaaatttgttcgaaaaaattttcctatgatttttccttgaaaaaatctaaaaagatcatagccaagtaaagtatcatacgcagtatttatcgtataattatcaaaaaaattgaaaactaattgtttgtttctgaaataaaaatgaaactttcttttctttcttgattgctccccctcagtttggaactatggtaagatatgctagaaacgaaagattttttattcgtaaattcacagtggagaattcctctcctgatgcattttttctttcattgactattttatttttacaggaggtttttatgattggattattacgctatgccaaagactatcgtaaacagatcgtcttaggtcctttttttaagtttttagaagctgtgtttgaactggttttgccactccaaatggctgcactcgtggaccagggaattcgccaaaacaattggtcgaaagtagttgaaatgaccctctggatgattgcgatgtccgtcatcgggatgatctgtgcggtcatctgtcaatactatgcagccactgcttctcaaggttttggcacggaattacgcaatacattaatgaaaaaaatcaatttgttgtcccacaatgaattgaatctatttggaacagatacgttgatcactcgaatgaccaatgatatcaaccaaatgcaagttgcattggctatgttgatccgtttagtcgtcagagcaccttttttgagtattggttcagtgatcatggcgtttgtcatcgattggcaagcgggcttgattttcttatgtgtgctgccacttttttgtatcattttattttggatcattagcaagacagtgccattatataagaaagtccagatccgcttggacgaactaaatgaactagtcagccaaaatttgagcggtattcgcgtgattcgtgcttttgctcgatcaaaaactgagaccaaacgttttgaccaagccacagatgatttgaccaatgtctatattcgtgtgaccaatctttctgcattattgaccccggctacaaccatgattatgaacttaggaattattgcactcttttactttggcggtttcaaagtgaacatcggaaacttggaacagggggaagtactggcgttggtcaattatatgaaccaaatgctgttggcactgatcgttgtatcgaatctcgtcatcatttttactcgcgctgccgcttcggcttcacggatcaatgaagttcttgatacagaaccgtcgattgatgatagtttatctgaggtttttatggatcaacaaaaacaggcaggtgcccttcgtttcgaacatgtggactttcgcttttcacctaactatggcttagcattaaaaaatatcgattttgagattgttcctggcacaaccttgggcatcactggtccaactggcagtgggaaatcgacattaacgcaactgatcccgcgtttttatgacacagctgctggtaaagtgatcgttgatggacaggatgtacgcaagtggccgctgaaacaattaagacaaaaaattgccatggttcctcaaacggcggttctgttcactggtacgattcgtgaaaacttacaatggggaaaaaaagatgcgacagacgaggaatgctggcaagcattagagatcgcccaaagtcgcgacttcgtcgaagcactaccgcaaaagttggatacgccgatttttgaaggaggcaagaacttttctggtgggcaaaaacaacgcttaacgattgctcgagcaattattgctaaacctgatatattgattttggatgattcattaagtgcgctagattaccaaacagatctggatctgcggatggctttaaaagaaaaaattcgcggaacgattatcatcatttctcagcgtgttcgttcgattcaagacgcacagcagatcttagtgttagatcagggaaatctggtcgccaaaggcacccatgacgagttgatgatcacttccaaagcttatcaagaaattgtggcatctcaagaggaggaagaagaatgaaaaagaaatcatttgattggtctgccttccgccgctacctcccctatctcgctgtgtatgccaaagaaacttggactgctgtcgttttagggatcgctgctggcatctcaacggtttttatgacttatgaaataggtcaggctgtcgataaaatgattggtcctagcaaggttcatttcgaagaactttatcgcattctcgcgttgtttggcggtgtagtgatcgttactgttgtcagtcaatggctgatccaacgattagggaatcgagtggcctatctgtctgtcgctgatctgcgcaaagaaggttttgctcatttaaatacactacccttgcgttattacgatcaaacgtctcacgggaatatcgtcagtcgttttaccaatgacatggataatatctcaattgcggttgctgctgtcttcaaccaattattctccggtatctctgtcgtgctgattgccttggtagttatggttaagatgagtgtgccactgactctcgtcgttcttgtttcaacaccgatcatctttttagtcaattggatcgtggcacgaacatcacaagcagattttgcgcgtcaacaagagatcgtcggtgaaatttctggattcgttaccgaaatgatcggcaatcaaaaaattgtcaaagcatttgaacgagaagcaatcaaccaagaacagtttgaaatgatcaatgacgaattaaaccttcgtggccgaaaagcacagttttcttcctcgttgaccaatccgctttcccgttttgttgaccatctttcctatctgtctgtcggcttcgtcggtggtttattgtacttttcaggctcggggctggtaacagttgggatgatttcaagctttacgatctattctagccaattttcaaaaccatttattgaactgtcaggcatcaccactcagattcagactgcattagctggtttggcacgaaccttccagttattggatcaagtgccagaaagtgcggatgacacagcaacacaagcgatgaaggaaatcaaaggtaaaatcgactttgaaaatgtggcttttgcttatgatccaggacaaaaactgatcgaaaacttttcttttacagctgaaccaggtgaaacggtggcaattgtcggaaagactggtgccggtaaatcgacactagtcaatttgctgatgcgtttctacgatgttgatcagggaactatccgagtagacggcgtcgatattcgtcaattgcagcgaacagcgttacgaaagagttttggtatggtccttcaagacacgtggctgttcgatgcttctttaagagagaatctccaatatggtaatgacacggctaccgatgaagaaatatacgatgctttaaaaaatgcatatatgtatgaatacgttatgcggttaccagataaattggatacgccgattgggcaacaaggcatcaagatttccgatgggcagcgacaattactgaccattgctcgtactatgatcagtaatcccccgatgctgatcctcgatgaagccaccagttcagtcgatacactgacagaaaagaaaattcaggatgcctttttgaaaatgatggaaggaaaaaccagtttcgtcattgcccaccgcttatcaacgatccgtgcggctgataaaattttggttatggatgccggacaaatcgtcgaacaaggtactcatgaagaattgttagcggaaaaagggtattattaccgtctctaccatgctcaatttcaacattaacagtcacatgttgatagattaacgctaaaagaagtggttccctaaaagaaccacttctttttttaaaattgagaattgttatttactccaaacatcgctatattccggtttacgttcaaactctttttttgcaaatggacagagtggaatgattgttttcttttccgcgcgcgctttttctaccccttttgccactaacttttctgccagtccttgaccacgataggctggatcgacaaaagtatgatcaatgatcattcgttttgttcctgcattcgaccaagtcatttcgccgatctctttctcgccgtctaataaggcaaaacgatttttttcttccttgatttccattagttttctcccctttgaataaattttaatgcgccgcttggacaaggttggttcacttgagcaacttgttctttttgagcattatcgggaatgacccacggtcgacgtcctacctcaaaaacagttggattacctcaaacacacttcccactgtgaatacaaatgtctttgtgagaataaacatcgaatgctgagccatgatatttgcgatacccatcagcaagcaactgttcctctgcgtgttcttttaagtgctctgtcgttgttttccctccgtcactgcttgacttttattgaccgccttcatcataagctaaatcaacaaaaaaataaaacaatcgccatttatacgtaaaagatttagcagaaaaaacaactctactagaaaaaactgaaacataagcacttcaacaaacaaacgatccgaagacacatcgaatcctctctacaatccgatcctcgtccctagtcacagagaaaagaattttttctcatgtctagtttggatcatttcgtctgcttttgcttctgttacagctctattcgtttgatttcatttgatagtgattactgaaaagaaccttagtcattgttgatcgctgttagatgaaccatttgtgttgcatagtcgccggataaagcaggatcaatatagaaaccgatctgcatcaattcatcgccgccgattttatatccccccatttgatacactgtatctgccgctaatcccgccaatttgagagtgattagcggtgcagatgcttcggctaatacacggaaatagaaaacaatcgcttcttgtttatcttcagaaacgtacatccatgcagtatcatttcctgcaaaaggactcaacaagcgaataaacgtgccatattggaagagttgtcgatgttttttataaaaggcaacttgctctttgatggctgctttttcttcatcggtcactgtcgtcaaatccagctcatagcccaagacaccagacattgcaacgtttccgcggatcgctaagtcagtgatccgctgtgtttgatggttaggcactgctgaaacatgcgaacccatgctagaagccgggtatgacaggctggttccatattggattttcaaacgggctatcgcatcggtattatcactcgtccatatctgcggcatgtaatacaagaaacctgcatcaaaacgaccacccccgccagaacatccttcaaacaaaatagtgggatgagcagctgtcaatcgttctaaaaagtcatacagacctaaaatatagcgatggaacacctccccttgctgggtaggatctaacaataatgaatagacatccgtcatgttgcgattcatgtcccacttaatataatcaacgggcacttcgttaaatagaagggctaactgatcaaaaatatgtttccgaacatcttctctagaaaagtccaatacaaactgactgcgacttaatgcgggagaacgtccaggtacttttaaggcccactcggggtgctgacgatacaattcgctcgcttctgagatcatttccggctctaaccagagaccgaatttcaaacccttctgatggactttttccgcaaaccctcgcagaccagaagctaactttccttcattctcataccagtcacccagagaagtcaaatcattttctcgtgcaccaaaccaaccgtcatccaaaacaaacaattcaattcccaatgccttcgcttcatcgacgatctgctccagtttttcttcatcgaaatcaaaataagtggcttcccagttattgatcaacgtcggacgttcagtcagctgatactgtccacgaataagatgactattataaaagcgatgataggtttgtgacatttggttgagcccttgattactataaactgtaaccacttctggtgattggaagctttcctgaggtggtactgtccaggcaaatcgataactactgatgcccatgatgagccgcgtttgatcataaggatctttttcgataatcgtttcgtgattgccgctatacagtaaactaacgccataacattctcccgagaattctgttgtagcgggatctgccaaaataacaaaaggattctgttgatggctgctggaacctcgcttgctgtccaatttcttgatacctgtctgaactggttctcgactgatttgccgttctttcgcccatgcaccattcaattggatcaaatcaagcggccggttgggaaaatccagtgattgactggctagttgatggataacgattggttcaagaccgtcattttttaaggcacttgaacgaatgattgctgatgtatcagtaaaaatactataattcaaaaccaattcaagcgcggcaacttcatctcgcaatatgatttgcaacgtttcgatttcttgcggagcaccgtgagtttgaggcaaccccgcaagtgctggtttgccttgactgatttcatggctttgatagataaaatgcgcaacatgactgccatttggcagttggatatcatatgccgcttcacgaaaatcaccgaacccattcccaggaaattccatcatcagcgtatccagcgagaataagcgatccttgctgcctgctggattcggcgaaaaagaacgatctaatcgcgggtaacgataatggccagaataatgggtaattttctttccaaagtagatatgcgctaaatttccaccttcttcgatctgcatcacataactgattttgttgttgcttaaatgaaaaatttggttttttttatcaaaatggatcatttcatttcctcgttttctcttttctttacttcacagaacctaacatgccttgtacgaattgtttttgtaatacgaaaaagataatcgctgttggcaaagtggcgatcacgatcccgcacatcatcatgccgtaatccggtgtataggaagcccccatcgcagataaaaccaacggaactgtccgtttatccggtgattgcaaggcaactaatggccacaagtagttgttccagctattcataaaggtaatgatcgctgctgctgcatacgtatttttagcagtaggcatatagactcggaagaaaatacttaactcattcagcccatcaatgcgggctgcttctactaattctttagggaaagctttgatattttggcggaaaaagaaaatcaggaacgctgtacaaacagaaggtaaaatgaccactgcaaaagtattgattccgattggggttccgctaagctgactaaacatgcggtataacggaatcatcaaagccgcaaaaggaaccatcatcgataagagtaaaatattgaaaatgcgatcttttgttttggctcgatagatctcaaacccatagcccgccatggaagaaaacatcaatgcgaagacggtcgtaatgaccgcaatcactgcagagttgcccaaagcacgagtaaagttcagttcagaagcaaataaattttggaaattgatcaccagctgatcaccgatcatgatttttcctgccacaatgtcaaaggtttgattggtcattcccaataccatccagacaaatggaaagacggaaataaaggccaaaagacctaagaaaagatactttaagcttaaagagagtgttttcaattttctttccctcctaattttgtttggatgacggataagaccacaatagcgatcacgatcacaaaggatactgccgccgcatagccaaagttcggggtgaatttataacttaaattataaatgtactgcgagagcgtggtggttgcattggcaggtcccccacctgtaatattttgtacttcgtcaaataattgcaatgttccgatcgttgaagtaattgtcgtgaataaaatgattggccgcaaattaggaatagttatcttgaaaagttgatcccatttagtcgcaccatcaatttcagcagcttcatagatgctaggatcaatgttttgcataccagaaataaagaaaatcatattatagcctgtccagcgccaagtaatggcaaaaataatcaagacttttgcccagaaaggatccgttagccattgaatcggcacctcaatcaaatgaatttgcattaaaaaattattgactaacccattcgctgagaataaacttttcatgatcaacgagtaagagaccaatgaagtgatacaaggtaaaaacaaggccgttcggaaaagacctttgaattttaattttttgtcatttagtatgttcgagacgatcaatgccaaaaacagcatgatcggtacttggattaataagtataaaaatgtattaccaaaagctttcttgaaggttgagtcactcagcatccgctgatagtttcccaaaccgttgaatgacatcgttgtcggcggtcccgactggaaagacgtaaaaagagctgaaatcataggaacaaatactaatagtgtaatcaagatcacaggcaaagaaataaacgcgtttccattcgcaaaccaatttttcgatttatttttcatggtgattcctccttcaaacgacactatggcaccaatctaatgactatacgaacgattgctgcttaacagtctcctctaatgggaaattattggtaccagcagctatcgttcgtatctgatttgttgattatgaaaccatagctaaatgagtggcttagtttgcgatttgtgcttctaattgtgtttgtgcatcttctagtactttatcgatatcttccccattgattactcgctgcaagctttctgtcaatacagattcgatcgcataagtatgattgccgtagttgacggccgggatctcttgtgaccattgagagaagtcttggaaaactttttgtcctccataaaaatcaagtcctgaagtatattcttttgtctcttcggcagcattcatcgttgaaaccagcccaatttcagttgccaatgttcccatcaattctttatttgaagcaaacgttttcgctaaaaagtctttcgcattctcttcaccagctacgcctttaatgacataccatcctgctccgccaatacttgatgcgttcactgaattgccaccagctagtgccggaatcggtgcaatcgcccatttgccgctttgatcttcagccccttgaatcgtactagaataccaagcgcctgttggtgctgcagcaacatttccggattggactgcattgacgccgccatcccaatcagagacttgttcaactaatccttcattcagtagtgtcgccaatacattcaagccggctttgaatgattcgttgtctttaatcgttactgtggtgccgtcttcaccggtataccattcaccagctgactgcatgatgatccgtgccaatcccaaatcgcttggatccagagacatcatggcatgtcccgttttctccttgacatctttggcaatttgaataaagtcatcccaggtaatatcttggagatcagcagcttcatatcctgcatctgctaaataatctgtacgataaaacagccctgctaccccactatcaaaaggtacaccgtagatcacatcatcgattttgttgacggcgaatttgtagctggaaaagtcatcttcattgacaatatcagttaagtcgctgaaagcatccggataggaagataaatagccttgaatacgatagtcttcgatcaaaacgatatttggcaagccatccgtattgcctgatgctagactagtgttcaacttttgaacgatgtcatcctgtgacatggtcactacttccacatcaacatccttgttttcgtaaacctttttcgcttcattgacagctttgatattgaaagtctcatcccaagcccaaactgtaaccttatcagaagaacctccagtgtcaccagtactttcgttgttgctgccacaagctgtcaatgtcaatacagtagcggcagtcacaagtgatgcaagcaattttttcatttttctccctctttccttttaattacatttttactatacactggagttgtaaacggatacaatacgcgtggaagagcttactaaaatagtccaaaaatagaaaatttttaccaatacctttcttttatgaaagcgtttatactagaataaagaaataggggggataccatgcatcatttacatacagtcttgcttgtggatgacgagaccactattcgtgatggtttaaaacatatgattcgttgggagcaagaaggttttcgcttgctaggagatgcagcaaacggacaggaggctctaaacctgatccagcaattacagccagagatcgtgatcacagatttaaaaatgccgcaaatggacggcatccaattaacaaccatcattcaacaacaatacccatctatccattttctggtattgagcagttatgatgattttcactatgtcagtcagtcttttaagaacggtgccattgattacttgctaaagccaacattgacgcctgctttgttgctgaaagccctaaacaccatccgcgaaaaaaaatctgatacccgccaaataaccgctgaggtcccattacaagaatctttgaatcgctatctggctgggtatgaagaaccacttactccttttgctgactatcttgaaatagctatgaaacagcaactatgttttctttatacgaatgtcagttattttcgttctactgaacagctttttcatgcattgacagaattttcgcaatcgaatactcacttaaaaacattagcgttcaagaccagtaacaatgatgcagggctattgatcagttattcagcagaatatgattttttttcctctttgaaaaaatgtttggaccagttgacctataccgaaccaaatgccttttttacccttggatgcccgtttgaatcgattgacgacttacgcacagcttttctgactctcaaagataaaagtcgggaacaatcgtttttttacaaacagcagcggcttgtttttgagcatgaactttttatgtacatggaaagtgatcgttttgatacaaaaaaatttttgcgggcattattagacaataatttcctgttggggattacgcgtatcgaagactatttcaatgagatgattctatcaaatgttgatccgaactttctaaaacagcaggccagcagtattttttatacgctattatcccggttagaagaagaatttccaacagccccccgctttagtcgcttgcgagcggaatttcttcatgagatcggccatgtcttatatttggaggatttctccgatttgttgttgtcaacgatcgatgagatacgactgcaactgacagccctctcccctatggatgaagatgacttactggtctcgatccagcgcttcattcaagacaattatatgaagagcctctcactatctgagttggcagaaacgttccactttagttatacctacttgtcagctttcctttcttcaaaattaaaaatgagtttctctgattatctaaaaaatacacgtctagaaaaagccaaagagttgctgacccaatctgagttgaatttgtcagaaatcagtgaagcagttggttattccgatatcagctatttttctcgaatctttaaaaaagaatttcaagtcactccttctaagtatcggcggttgaaccaattatgagaatccaacagtggctcaaaaaaaatgaattgttcagccgaatctttttgtttgttgtggtaggagtaatcagtgtttgtttactgacagtgatcgttatctatggacggtccaaagatgcttatgtggcttcgtatcagagctcgaaccgcttgcttttggataagatccaggaagattatgagcgcttgaatgagaatatcaatcgtatttttgatgtcgtcgatgagagcaaagccgtagaaaattatttaaaaggacagctaaatcagggaagaacgattttagaactcaatgaacagttgaaagatactcgctcgctttttcaaacgattccttccaacttggtattgattggaacgaacggacgatcattctttcaaaatgatgctgtccgaaaccagtcggttgaaacttttttggcaagtgaatttacgcagcaaatcaatgaaaatgaggctattagtcaatactattttctggagcaagggttgagcacttctacgagccattcaccaggactgatgtacgtgcggaaattaatgaaagacgatgctttattcggttatgcattgatttttttgaaagaatctgatttttcttccatctatcggcaattgttagacacaacgctgcataccatctatgtggtcaatgatcagggacagatcttatccacttctgaagaacaaaaattaggtacagcttttgattcagctatgatcgaagtgaaaaatgattcagtgaatcagatgcctctttattcttatcagtttactttttatgatctgctggatgaatcacatttagtacgcaacatgaatctgatcaagcctgccgtatggatcgcttttctcagtatcttgctctttagcctgtttgctttctggatcattcgtacgatcacacaaccaatttatcagttgatcgacaaattaccggcagtcacacagggtgatttcagcaacaaggtctcgatcaacgggacctatgaaacacaggaactaggacgtgcctataatttgatgcttgaggatttagaatcgtatgtcgatcatttgatgattactgaagcggaaaaacgcaaatttgaaatccgttccttgcaaatgcagattcaacctcattttgtttacaatacactcaccgcaatcaaatttttgatttggcaaaatgaacaggagaaagcaacacaagccatcgatagtttcgtccaattgcttcgccataccttcaaccgcaaagagatcgttccattaaaagatgaactcgccatcgtagaagaatatctaatcttgatgaacgttcgttatggtgaccggattcaatcagcgattttctcagcagaagaatgtgaaaattgtttggttccaaaaatgatcttgcagccaatcatcgaaaatgcttatctgcatgcgtttcctgaagaagagaaaggttacattcaaatcttctctcgtatcagtaaatcagggctagtcatcgaaatcattgatacaggtatcggctttgatgaagcatcttcggtgattaggaaccagacaagcgaacattattctggtatcggattggagaatatcgatcaacgaatcaaattactctacggggaaaaatatggcctgacagttgactctcgtgtcaatgaaggaacgactgtgcgcttattattgccaaaacagtaagtaacataattcttaaaagagccaaaaaaaatccagccattcgcactccggctatttttctcaaatctaagaaaatagcttccccagagaggccatgggtggatttcttaatcttaatcgcttacgttttttccattggaggcaatgacttattgctataaaaaaccaatcatcaatgaaccggcttccattggaatcctccattgatgattggttactccctatttttgtgggtatcttttacttttagatccgattttcgtgatccgcagttttgactaagttcgcaccgaccatgccgccgattgatgttaaaactagtcctaagaccattgctataaagccccatatggatgctttagcagtagcatcacttatttcatcagcttttttacgcgcatctttgactgcttgatcgatatcttgttttgcttgttcaagattttgctgtgctgtttcaatttgttgttgtgcttcatcagaagctttttgtaagccattgacaatattttgtgttgcttcttgtgcttcttgttgatttaaatcggtatttttcgcaaccgcatttgaaatggcttcttcgtcaacagaatcgctgatttttgttgcccgatctttgagcttcgttgaaagatcatcgatgatttcgtcagctttatttggatccgtagcaattttcttccctgcatcggtaatatcgctcgttgcatcagaaacttgatcttgcaagtagtttggctgtaattcaggaacgtcagtatcttttaatacatcgcggacatccgtttccaattgatcggtattaatatctcccatattccctgtgatctcatcaaaggcctttgatgcgacatctgctgttcccgatgcgacattctctacgccacttccgacagctgaagcaatgttgcccagtaatgagccgacaacagaaaatgccccaattgttacatatgataacatgacgattgtaacgatcatactggttgcccaagtaagaaatccatgtaccaaaccaacgcgtctagctgctacaccagaaacaaatcctgctccgaacaatgaaagaatcaatgtcacaacagtccaaatcatcaaacctgttcccacaccatccaatgggttgtttgaggtaggttccaccatgccaaagccgatcgctgagccgattaatgaaaatgtcataaataatgcaataaacgtcacgactcctgcgaaaatagagccccaagataagttataacctgcctcccgctcatttgctcctaaataatctctaaatccgtgtttcattttacatcctcctttttttcctctaaaaccagtctaacaaccctacgtttttttatcaatcaagccgacttatcgctcgcccagaagtaaaaatacatttgtttttctattcatcagcactagcttttcaacttatatttattaggttttgtcaccatttcttgaaagataataaaaataatcgtttttgaagaaacccacgccattctcaattgtctcctaaccattctcacccctaaatggacaacaatttttcagattatttccatgtaaacaaaaaagcacaactaacatctctcttgttcgctaagaataatcgtcaaaaagcttttataccgcctttttctaagttcagcatgtaggatttcctaaggatcagcatcgtccatttactgaaatcacatagataaaaataagtacatgcacttgtcactgttttttaacttgtaggaacaggtattatgtgttattttaaaaacaaaaaatcttcttatatcgttcgtttattaattacgtacatatatttaaagaccgaataattattctatagtgattcttttactctaaaaaaacgcataaaaaaaaagagaaaatctgctatttttgaatagcgattttcttcacataaaatccaatgataattttacaccgagattatttaattacacaacacgacaaaagaagaacttttttaatcaaaaattggtatctcaaacttacatttttgattcattattaaataatatttatgataatatttttaaaaggaggatgattatgtttgaagatctgttactcaccaatcatgcaaagaaaaaattagcaattttgacttatttaaatgagaataccaatcaaccaatcaatatcagtaaaatcgccgagcatctgggcttgtcttatcacgggatagcaccactcatagaggaaatgcaacaagagttttcagcgctttatcaagtttcgttatgtgaaaaaggtttcaaggttcgttcattagaagaaccactttcctattcactttatcagaagtatttgattcaggaaagccttgctttccaacttctacttacatcgatcatgaacccggaaatgaccatcaatgatttttcaaccgttcattttgtcagtcattcaacgatcacccgggcacttaaaccattgaatacttatttattgggaaaagaaatccatttgaatgtttctcagttgaaactgactggaaatgaaatcaatatccgttccttttacgttcaaattttaacttatttagagaactcaccattagaagcggattacttaacggacttcagtgatcaaacggttttgatcaacgaattagcattacaaaagttttctcctgttaaccaacgactgatcttagtcattttatttgtatccaaacttcgtttcgaacaaggctatttgcttaacccaatcaatggttttgaaaaattattttcaaagatgaaccatcctctagaaaattattttacggcatttatgactgacgaaaagcaagtaacttatcagatcaattatgtcaaaggaatgctgttctttctagtccgtttcgctgagccaacaccagaaagagctgctctactttgtgatttctatgaacagatcaaagaagatgatcctatttttcatgagtttatggctgattttagtcacgtattattaccagaaatcgttgggatcccttttgatgaagaagtattttctgaaattcaaaaagatagcttcattattctgtatattttttatgcaaacaatggcctattgattgatttttggtctcaaaatgagttgaatctatcctttcaaaagaaaggatttacaaatctacagaaaaagattcgtccatttttgacaaaatacactcgacgtgttggttatgaatggctcaaaaaagccaaatcgctagtcctagactatctgacttttttcatatatccgttttatcaacagcatcatttacaaaaattacaggtgggaatcattccttcattgaatttatcagccattcagcaaatcagttttttactggatcacattcaatttgtggactatgatatcgtaagaaaccacgaaaaagactttgactattacatcgttccagcaaatagattgttgccagcaattgagtatcctgcttatgtcatggaagaaactgagactctaaaagagttgtcgccattatttgacgctttatgggaggaatatctgacaatcaacgacttttcgataaactaaaaaaccagtggcttcctttttggaatgccactggttttctgtctatcattcttgatttaacatagaaaaaagcagaaatcgctgttttcctgctttttcctacttcaagttcctgtttcctcctaagatcgacagcctggaatgcctgctaagcaggactttggggagaggtcaacgaccttggaggagcaaatagtaaattattactagaaaccacctattttttgcgctatcgaaatctgaattcaatcagatttactgaacgaacgtttagcgtaagaaagaaaaaatgttgatcatattttcaacaacttcccatggaaatccaaataattgaaacattttcttttcctcctttaattgactttcctttagtttaattggaaaataggactatagttgatttggactattttttcgtccacctattttctaggtgcatttaggaggtgcttttttggaagccaatctattactgaaaaagttacgtactgaacgtaatctttcccaaagaaagttagcagccgatatatctgagcggagcacattagctacttttgaacaaaaagggcatcgaattgcttttgatatcctttacaaataccttgatcgcttgaatgtgactctcgaagaatttgaataccatttgacaaataatcaattaaatgaaaagaagcaactctcgaaacaatttcacaatgcttattaccaacatgattttgatcagctggccgtcttgatcgaagaatctaaaacaacgtatcaggaaacgcaagactttttctattatttgctttatagccaatactatttgatcttgaagaaaaagggatacgtacatactatcgatgaaacagaaagaattgaaaccgtgataaaaggttatctcgacaaaatcgaaacttggggaagatttgaaatcaccatttttgcaaatctaatgtttctttttacagacgaatatattttgtttcaaatcgagcaattgaataagcaggagttttataataacttgcttagtctcaattatcatatttattctaagctgttgaccaacgctgcctttcttttcattgaccgcagtcaaatcgatcatcttaaacaaattttgttttatatgaccaaaaatattccattagacaatgaccggattcgattgatgatccgctattttgaaggaatcatcgcgattttccatggtgagatcgaaactgggaaacaaacaatttcaaagactattgagatcctaaactttttaggacaatctgcctatgccgctgaattaacagaattagcaaccaacgtcctgttgaccgtagcgccttctgaagaacctttcttataatgtcgttgttctcaaaatcaatgtaagaaaaaaaaacgatctgaatgccttttttcggccccaataaatggtgaccggaaacagtgactttcagatcgttttctttaattgattaatccaagggaagttttccattcaaggactcgtttgacggaagcatcgatggctgcttccggataattaccacttctgacagcatccacaatcactgggatctgttgctgataggtagatgacatcactaaatcattccctgcttctaatgctctcagccctgcttctgattgggaaataaagtctgctaggcccgccatatccatgtcatccgtcatgattactcctttgaaacctagctgcttcctcaataaatcatggacaggcttcgaaatagaggctggtgcgctggcatcaatactggtaacaatattatgtgagactaaaatactgtcagctcccgctttgattccagcttcaaaaggcaagaaatcattcgtttccaactcgtctaacgaacgttcatctgtaacgatctctacatgagaatcacggttattgccgtatccgggaaaatgcttcaatgttgagccaatccgcttctctttcaaaactgcaatgtttctacgaacaaattcactggttccttcggcatctaagcctatggttcgatcgtagataaaggcattcggatcagtcgctacatcggcgaccggaaacagaccggtagaaatgccatattcgtggaaaatagctgccttttgagcagtatcttcttcaattgcttgccagcccccttgttggtaaagttgctgaggggataaaaatggtgtttgtaccaatgcagggttgcgactgattcgagtgacagttcccccttcttcgtccattccgatcagcaaaggtatggaactggcttgctgataatcagcaatcttttgcttcaacgtctcagctgtctcattctccgtatcacgtccgaataagacatagccgcctaaatgataggtttgtatatcttcgacttgattgatttcaggcactcgtacaaaaaatagttgcccgactttttcttctagactcatttggtcaatccgcttatcaatcgtcgtttcctcctcagttgattgttcgggaatactcgactcggtacttagagaacttgttgacgttgtttgtgaagcgtttgtcggttgttccccatttgactgttggtccatcagccacttcattcctcctataatgagcaacagaagcaaaataaagccacccataaggattccttttttattcataaattcctccagttcataaattcctcgtcttattttacatcagcctattttagcatgccttttaaggtaaaaaaagcgaacacgacacactcaagtgtactgttcgctttattggatgtttgttttttattctttttttgttgctaaaatgattaggtaaaacgccgagtcaagcgtttataaggcactgcgcgcccaacaaagtagatcaaaactgtctgaataggaaacatgataacagctttcatcaatcgagccgaccaaattgcccagcttgttaatggaatattcagcatcattgccaaccagatcggtgtcaaaatcaatgtgatcagaagggtattcagcaagaccactgttgctgcccgtttccaagttacttcctttctataaaaaaagtaaccgtagatcaacccacctacgaatgcattgatcgtaaatccgaagaaataagcggatttagggaataaaatcattcctgctatatcagcgaccgaagcccctacagcagtccagaatggcccaaaaagcatccccataatcaactcaggaacaaaagtgaaggtgagtttcaaataggctgtttcaaaccccaagatttgcgacaagaccaccatcagggcaatcaaaagccccatgaccgcgatcatgtgtgcgtcgacttttcttttcataacgagcatctccttttagagctgctacaaattcatgcagcgaatgcgaaaataaaaccgcgaacgaatcgttcttcgtccaaaaggcaacatcccatcctttcgacacttaacgctttatttcctactctgatttatttaggtatctctacccagacaaactatagcacagattctagtggtcttcaattttagtccctttaatgacagctgttttttaagaatcgttcgtttttttgccgtatcttgggcaaaaattaaggcagagcagtaatggaacccaataccactgctctgccactttgattaacgttgatcagccaatgatattatcgttgatcaacacacgcttgatgtttttcaattcgtgagcaatctcaacttgctcgatcgtcaaacgttgatttacttcttccatcgaatggatttctttgttcaattcattgacattgtttaccaaatttttcagtgcttctaaaatcaattgattactgtccattattcctacactccttgtctttattcttctctcgaacgttctgaaatagcggcgctttcgacgactttttttgttttataaaagaatttgtacagtacaataacaacgaccggaatcactccgcaaatgatatagatttgagaataattaaacatcccctttaagctacctaatgcataaggaccgacacctaatcctaagtctagaccaatgaaataagtagaaagtgcaacaccgatccgatgagaatcgacttcttttagacatacggcttgtccattagacatgaatgtaccatagccaagtccaacaaaacagccagaaatcaacagcatcaagctattgccagtaatactcaacaagaacaatcctaatgtcaagaagataaaacttggatacatcactgcatctgcaccacgacgatcaaacaagcgacctgtcattggtcgagtgaaggttacggataatgcataaacaacaaagaagaatgcgcctgcggtttctaggccaaggtttccggcataaatagaaaggaaacctaatacactggaataagacaacccaatcaaaaaggccagacctgaaataaacaagacttttggctcaacaaaactgctgaatgaccatttctttagttctgctcggtgttctggtgttaaggaaatatttttcactgggaaagcgaaacaagcaatggctgttactatcgaaagagcagttgctaataggataataaaatcaaaaccaaaagagggtaacagcagcattccgataaatggaccgacagcagctgctaaactcgtgcttaatccatagtagttgattccttctccatgttttgaagagggaatgtacgccgtaacaattgcatttgccgctgtagacactgctccataggcgaaaccattcaagaaacggacaccatccaaaatcatgatattcgatgaaatcaaataagccgccgtagttatgacataaaaaatcattccccaacgtaagatggcttttcgtccaactagctccaataccttaccaatatacaagcgggcaatcaatgttcctataatatagatccctgctgcaaacccagcttgtgcagcggaagcccctaattcttgcgtagcaaactttgccgtgatgacgacaaaacaataatagaccagaaaaacaataaaattaatcaatgtaatagtaataaaacctttgttccatagtttttctgtttgttgctcctgttctgacatgttgtgttttgctccttttttattgtttctttgtttcatcatcctctttctcagatgacaggtctaactatacctgatatttcaagagcgcaaattcgcttttgttgctgaaaaaacgcaaaaacataatacattaacatttgttattgctttttgagttagaatgttctttaattaaaaaagaatattcacccagatttggcgaatgtgactgttcattgaaaaggaaacactataggaataagaggagtgctttgtttggtaaaacagctattaatggactatttagaacaaaataatattccagtagtcatacgtaaaaaaagaagttatttgacgtatgaaggaatccctgatcgttatgtctatattttgaaaaaagggatcatcaagacaagtgtcgtcactcatgaggggcgtgaattcaatttgcgctatatgaatgatttcgatattgtttctctttttaaagatgaatcttcacaagaagtcgaagcgcccttcaatgtgcgtgtcgagtcagaagaagccgaattatataagatcgtgcgcgatcaattctggacagatgtcaatcaaaatcgggcgttacaagattatgtcaaagagtactatcgcaaaaatctaatgtactccatgaaaaaaatgcagcaaatgctgatgaatggcaaatttggtgcggtctgtacacaattgaatgaattatacgaaacctttggggtaccagtgggtgaaggaaccttgattgattttgaggtaaccaatgaggaaatcgcccgcttttgcggtatcacttcagcaagtagtgtcaatcgaatgatgcagcggttgagagaaagcggtgctatcaagactcaagaccggaaactgttggttttagatatcgggtcaattcgcgaaaatattatttattaaaaaaggcagctagtcgaatttcttttgactagctgcctttttgtttaacgtgttttgtgttgtttgaattaaatgaaatgaactgtttctgctaccgtgatcgttggatctaatgattggatgactggacaattcggagaaacgagtttgagacagcgaatggctttttcttgatattccgctgaaatccgcgcataaaaattgatctggatcgaagagatcggctctgctttcttcgtagaatctctcgtataactgacttcgattttttcaatctcagcaggcacatgagaattttccaaaacagaagtatacacataaccgccacaagctgcggctgcagttacaagcatctgaaccggtgagtatcctagttcccgagccaagacccagttgccattttgctgtggtaattctaatttatcttttcctttaaccagtgttaaggtttcaactgccatttttttctctccttacataatgttctttttctacttctatccattcaaaaagaggacttaaagtgatcgtttcttggatgtctttctgatccattgctgctcgagccagaattggatcagcgattggtgctgctgccaatagtttctttgtataaggatgctgagggctttcaaagagtcgttttgttggcgccaattcaaccaattttccttgatacatgactgcggtgcggtcactgatatgacggatcacggataaatcatgggaaataaataaataggacaatgaaaattctttttgcagctttagaagtaattgaatgatctgcgcttgaatcgacacatctaatgcagaagttggttcatcacacaagacaaaggctggtcgattaacgactgctcgagcaatcccgatccgttgacgttgtccaccactgaaattccgaggaaatttatggatgtcctctcctttgattccaacgatcgcaagtatctctttagcctttgctcgtgcagcgtctttcgtttctttcagtaaaggctccatcactaactccaaagcagtcattcgtggattcaacgcagaataaggatcttgaaaaattacttgcatctgctgatagcgtttcttttgttcctctggtggcaaacttgccagctcttgtccctcaaaaaaaactttgcctgcagataaagtttccagattcaaaatactacggcctaatgttgttttaccactgcctgattctcctacaaggcctagagtttcgccccgatggatcgtcaaactaacattctctactgcgcgcacttctgtcactaccccacgccagtttttgcttcgaaacgttttgctggcctcttcgactcgtatcaattccttcaattgcttgcccctccttcccaaacacgatgcgtctcagagatttcccgaacgtgtaacacatcaggaagttcttcctgatagtcaaagacaactgtttcttctttatcccctaagtgggcggcctcgagcagttgcttcgtatagagatgctgaggttgatagaaaatttcttcagtagtcccttcctctaccactcttccttggtacatcaccttgataaaatcacacatgccagcgacaaccccaaaatcatgggtcaccagaacgaccgaaaggttctctgctcgctgcaattgcttgatcaatgccaagatctgagcttgaatcgttacatctaatgcagtcgttggttcatctgcaatcagcaacttcggctgtgccaacagtgccatagcgatcatgacccgctgccgcatcccccctgataattcatggggatactgcttcatccgctgttcaggaagggggatccctaccttgttcaactccgcaatggcaattgtttgcgcagctttttttgacatcttctgatgtctgcgaatgacttcaatcaagtgatacccgatggttcgcaaagggttcaatgatgtcattggatcttgaaaaatcatggctagcggtaatttgctgcgatcaacaaccggttggccttcaaaaacaaacgagtcaaaggagtcggagatattttctggtaagatccccatcacgcttttcatcgtcatactcttgccactgcctgattcaccgacgatccccacgacttgtcctttaggaatgactaggtcgatttctttcagcagctgctgatctccttgttttctatgaaaaaacacgtttaagtttttcaccgtcagtaatggctctttcatgcttgctacacctcccgctgcaagacacgtttgatcatgtcccccagattattaaatgaatagatggtaaaaatcacgaataagccgggcagaattgccatataaggggctcgttgcaaactgctttgggcattttgcagcaaactcccccaagaagccattggctgttggattcccattcccaaaaaactcaacgcagattctgtcatgatcgctcctgagatgctggcagaagctgccacgatcagcgtaggtaaaactgctggaaaaatatggcggaaaataatactaaaggatgtccgaccaataaacttaccatagacaacatattctctttctttcgcagcaagtgtttctccccgaatcagacgagcgatattcatccacgaaaagcctccaattacaataatgatcgtcgtcaatcccggacgcagaaagacacttaaaacaatcactaataccaaccaaggaatggaagacaagacatcaacaagacgcatcaaaagactgtccacccaaccaccaaagtatccagcagctaaaccgaccatcgtgccgatcaatgtcgctgtaatcatcgctagtactcccactaataacgagacccgaccgccgtagacaactcgaatgaaatagtctcgtccaacttcatccgttccgaacagatgggcccagctaggtgcttgggacatattgctgacatccgtcgcattcggatcgattggaatcaaaggtgccgctaatgacaacaaaatcagcaacgtcaaaaagataaaagaaaaggcgtaaactggagaagagaaaatcgcctttctgattttcttcaatcgtttcatgaacgattccctcctttacgtattcttggatcaacaatcgaataaagaacatccgccaatagattgcctaaaataactaaggtcgctgacagcaacatgattgccatgatcacgggatagtccaaacttttcgtagcactcatcaaataaggaccgacccctggccagccatagatggtttctgtaatgattgctcctgtgaccagcattggcagtgccaaaccaatttgcgtcacgatcgggatcaacacattgcgactgatatgacggctaaaaatctgccatttcgtagcgtgaaatgcctgctgtacaacgacataatcttctgatacttgttgcgtagctgaggcgcgaatgtaccgagttaattctgggaaaaaagcgaccgtcagtgttgcataaggcaaaataaaatgttgcagaaaatcgttgaaatctccttcttttccaacagtatacatcccaatgataggaaacagattcagccgatacccaaaaagataaatcaaaatcattgcaaaccagaatgtaggcaccgcgattcctaaagaagcaataccgtcgatcagacgatcccatacttttcccttgtttgctgccgccaacagtccgagtaaaattgctaacagcaatgcagtcagatacgctggcagaaccagtcgaatcgtattagggattctgaccgctaattcttgagcgatactgttctgggatactaatgaaaatcccaagttccctgtaaggatgtttttgatccatagaaagtattgcactagaaatggttgatccaatccatagcgttgccgcaacagatcaatttgctcttgtgtcatatttggcgttgtgattgaatcgatcacatcataaggtgcgatatgaatcagtgaaaaaacgatgaatgaaataacgaatagcagaggaatagcctgcaatactcgcttcataatatatcggaacatggtttcccttctttctctcaaaaaaatcatgacagaaggcagctagacagataacaaatcgcatgcaccagaggagcaagaacctaagtatttcatccaactgatatccgaagaaacttgagatggctcctgtcatacaagagcggttgtaccttcagcgtctacctctatctcaaccatttcaggcattttcatctggatgttacttagggcacagcccaacttcttggtgcagatccgccaactttaaagaaggcgaatccgtctatgttttccgtctttctttgacttctgtcacaaccattcatgttacttgatcgtcaattttgacatatcttcaaatgtgtagattggaatcaagccagcttcttctacattggcaatgcgattgttgacggctaaaatctttttattatctacgataggatagattcgagcatcatcagcaatggcttgttgcagctggtcatataactctttccgttttgtttcatctaactcaaccgctgctttagcaaacaaatcatcggtagtattgttctgtgtttggaaataatttgagctgccatccgttttgaaaagcataccataaagatctggatcatttcccatgatatagccgcctaaaaataaattgtattttgtcgaaccggcttttttcaattctgtaaagatcgctgttccatcgccgccttccaatgaaacgttgatacctgcttgctgtaattgttgttgaatcaatgttgcctgaatcgtttgtgcaggatccgttgaagtaaatgctagattcagttggagattggatacacccgcttcttgcaaaagttctttggctttttccacatttgtttcatatttttccacgtcttcggtcgcgtaaggattgttcggtggcaagaaagaatatggcgtatcaaaatattcatcactcaaatacgctgcctgattcatttcatttttgttcaaagcataaagaaccgcttgtcttactttgacatctttgagggcatcagaatgagtattcaatcctagataaccaacccgattttcagtatacggatatactgagatcattgaatcatccaaatcttcaatatcagaaggcaagacaactgccgcatctacttcgcctttttgtaaagcgactttagccgtatcagtactttcaatgatccgcaacgtcacatttttgattgctgcttcaccgccgtaatagttttcattggcttcaaaagtaaaatattcgccgcgcttgtattcctttaatttgtaaggccctgttcctacgggggtttcaggcaattcgctaacagaaaaatcagtcacatctttataaatatgttcaggaatgatatacgtttcagttgcgatattatttaatgctgctgcacttgcagaaggtaaaacaaacttcactgtataatcatcaactttttcaatgctgaccggttttccatctacccataacgcatctgcattgccgttttcttttttcactttttgttcataagtaaaaacaacatcctctgcggtaaaggcttcgccatctgaccatttcacatcttttttcaaatgaaccgtcaaggacaagccatcctcagctggctcaacggaatctgctagtgcattttgggttgttccatccgcttcaacaatcactaaaggagaatagatcatgttggtgacagtcagcccccaacggtcactcgtattgattggattcgttgacgttggatcaccgctgatcgcataagtgaacgtgtctttatctcctgcttgagttgaagtttttgttgttgaatcttgtgtactggatgaggagcacgcagctaagaataaacctatactgataatcgctgtcccaatcaatccttttttccaatttttcatcgttctcctactttcttaccatacaggtatacttgatttttttgttactttatcaataatttctttgacttcatctgtttgataatacttaatgatcgtctgatacgtctgattttctttttcctccgctcgggccgcgatcacattgtaatacggtttggacgaatctgcgacaggctctaagaaaatcgcatcttctgttggcacaaatccggcatcaacagccatcccattgttaatcaatgaaatatcgacatccgttattgctcgcgcggtctgattggcgtccagcaacttgaacgtcagctgcttcgggttatcggtgatatcattcgtcgttggcagcagaccttttgattgatccaatgtgatcaccccggctgtctgcagcaacaataatgcgcggctctcatttgaaacgtcatttggtaacgcgacagtagcaccatcagccaattcagcaatgtctttgattttgtctgaataaatccccagtggattgagtgtggtataagcaatcgttgtattggaatatccgctttcctgattgacattatccataaaaatctctgtcaaggctgcgtgcagatcaatcgaaccgtcctctagtgccaggatgggctgacgataatcagtaaatttaacgagctgtagattgatttgctctttttccaacaattgttcctgaacatattcccaagcttcattttgctctccaacaaccccaagctttactgtagttgcctctgaggcaggtttgctgcagcctgccaaagcaaaaaccaatacgcctaaaaatacgctaacccattttttccaacttattttcatttttttcttcccctttttccccctttgagcgaagcctacagaagcaacgatccctttcttgtgattgtcgcaaatagacgcaatgactggatagaatacttagtacttaactacaactttacatttcctgctgtagtcagttgatcatcggactaactattcatatgtagtgtaactttatcttatacaccaaaaactgtcaataaagaaactctagtaaagccttgcgctatatctttctatagtactcgcaaaaaggggtttttttagatgtaagacaatgcctgcgtaagatccgcaatcaagtcctgactattctcgatcccaatagagagccgcaagagatccggcgtcaaaccataggactcccgtaactctttagggatatctgcatgtgtctgcgtcgtaggataagtgatgagactttcaactccgcccaaactttcagcaaatgtaaaaattgagagttccttcaaaaatgaacggactttcactgcctcctttaaccgaagactgatcatacctcctacaccaggatacagtacgtctttgattgctggctggcgttttaaaaacgcagtgatttcttttgcgttttgctcttgtctttcaaaccgtaacggcaacgtttttaaactgcgaatgaacaaccaacagtcgaagctgcttaaagttgggccagtggtattggcaagataggtcaagcgttcaccaagggagacttcttttgcaatgatcacaccagccaaaatatcattgtgacctgtcaggaacttggtcccagaatgaagaacgaggtctgcgcctagttccaacggtttttgtctcaatggtgtcaaaaaagtattgtcaacgatgagtaaagcattgacttgatgcgcgatctcggcgaccgcagacacatcgatttctgtcatcaatggatttgtcggagtttctaaaaagaccgccgcaatcgttgaactgatttgttcttcaagttcgtttagcgtattgaaatagtgaaaataagcaatctggcgcgcttgtaactcttcaaaaaaacgataactacccccatataaatctcttgatacgagaaattcactgccgcttgggaaaagttcaaaaatcaatgcgatcgcactcatacctgagctcgtgacgattcctcgagcgccattttctaaggtagccagcccagattctaatagctctctcgtcgggtttttggtacgtgtataatcataaccggtactttgacctaattcaggatgcgcataggtggtagagagatagattggtgcactgacagctcccgtcgcttgatccgaacgattgcctagttgtgctaaaaaagtcgtcatatcaacagtcataatcgtattttcctttcttggtttagtgtgctcaatgaagcgggataaagtcgttgtcgcaagattctgacgatagtagtgaaactagttgccttaactgccaaattgttcgttgatgagtagaatgaagcaatcatagccttttgtgaaacaatgaagcaaaatgagctgttttgatcattcgctgtggaaaacctgaccattgatggagggtagaagtaaatgagtacagcagtcactggtttaaaactagcgggcttttcagatcaaccttctttgtctagcgctcttttgtttcactgaaaaaaacattgactaaagtcactgccgcctatgtccgccctcccattcattacctatataataaccagtacgcgttggcagaatctgtaaatcatagggcgtgcgctggtaggtttcgtggatccagttactgaaaaacaaggacgcatgccctcgccagcgattgatgaccgttccttgctggtcggaaaaataatttttggggagtgccgttttgagccctttggctttatctcgcaaatattcttctttcaacgtttctgtatagtattccaaatgccctaaaagaaaactatttttatggtcatgggaaactaagagtgctggaccggtctctattcctgtaacaagcacattcagaggtgcaagtggcagctgcgcctcattgatccccgtataacgagaatggggcatcatgaaggaatcattaaaccctcgtatcagcggatgagcctcgatcactcgctgttcaaaaataccaaaaagtttttgcttatgaagcactttttcgataccataatgatagtacagcccagcttgtgctccccagcagatatgcaataccgatgtgcaatttgtttgactccaagccatgacttcctgaagttcctgccaataatcaatcatttcaaaaggcattttttcgactggtgctcctgtaatgatcaaggcatcgaaacgttcctcactgactgccttaaatgcgacataaaacttgtctagatgagtcgagctagtatttttgctttcatgttgctgcattttcaataatgttacttcgatttgcaaaggactttgggacaaaagctgcaacaattgattttctgtagtgattttttgcggcatcaagttgacgatcgcaattttcaaagggcgaatttcttgtttgatagctcgctcttgttgtaaagcaaaaatgttgtgcttcaaaatagctgctgccggtaattctttggggatgatgattggcatcttctcactcctttttcaatcgactcctatgaacatttactttttattaccttatcgtttctcgtggtttcacctatcgttgcttctgaacatggttggttcagtgtgacttgcatgccatgctttgcatgtcagtcgcagtgattcgagacgtggtgactacgttcccttcggtcccctagtactgttcatcatctgctcgtctactctgtgcttcgcctgcagtcgcttctaagcatagttcgctaagaaggacttgcatgccatgctttgcatgtcagtcgcagtgattcgggacgtggtgactacgttcccttcggtcgcctagtactgttcatcatctgctctgccatgctttgcatgtcagtcgcagtgattcgggacgtggtgactacgttcccttcggtcccctagtactgttcatcatctgctcgtctactctgtgcttcgcctgcagtcgcttctaagcatagttcgctaagaaggacttgcatgccatgctttgcatgtcagtcgcagtgattcgggacgtggtgactacgttcccttcggtcgcctagtactgttcatcatctgctctgccatgctttgcatgtcagtcgcagtgattcgggacgtggtgactacgttcccttcggtcgcctagtactgttcatcatctgctctgccatgctttgcatgtcagtcgcagtgattcacagcaaaaagtcgtcccttttatcgttaatgtaacgataaaagggacgactgactcgtgttaccaccctaattcgtgctgcctttgcaggcgtgcacctcaacagtaccaatgatacttggcgcgttatcgggcgcataccgtctatttggcgtgaaccaaataaaaactcagagctcatcttcaacgcctgtctcatgtctcctttttcaccaaccggagtctctgtaccttcaacgtagcgcttactcttctcttcaacgtttcatctctatttgtaatttctaagaattataatcgttctttcattcaatgtcaatccgcttttaagactttggcttatttctttgaaagatagagatattgttgatccatttgttcatagatttcttgcagatcatctcgtgagacttcacgatccttgtagccataaggatcgttgacatacattttgtctccatctattccagtaataacaacggaatggatcaatgtcgtttcgtagatcattcccgattgcgtcggccactcaaaaaaatcagcattggttggtacttgcaattcaagggtagcaatcatccagataggcgtgccctgctccaaaacttcaataatctcatcaaaagatttgtctcgaccacttaccacttgataggaagcccctaccatctggctcgcaactttggcgattggctctaccgcaacccccattgctccatcgccgccataaatattcccaacaaaaccttctcgtgggtctcctcgatgagtttcatctgcgtaaacagggacatagtctaatttggcagccagctcatttttatttgtatcatacccgtagaaattcaacagcatggataaagcagtgacttcacagccatttcctaaatattctggatcaaattggctttccaatggtacatctaatcgaatcacgggctcttctttttctgcagtcagatccagtcctgatatcgaagtcaccgattgtgccgcttgttcttgcttcttcacataaggagttgctccagctttatcatagaaaagccagataaagaacaaactaaaggtgagcagacctaaaagcaaactaatgcttttctttttcatcagtttactcctttcttctttgactattataccttgaatgtcaaaggaacgaaaagaatttatgttttagaaccataatttaggaaaacaatgcttctcaaagcgttgaatccaatgatttagaccatccctaaatgagcataaaaagaagctaagagaacatggagaaagttcccctagcatttatcattacgctttgtatttgttgtctaattctaagaaaggacttgtttcttttttcctagtaatagtttttttgcgcttgaaaaggaacgaatatcgaactgtttgcttagtgccccggcaacaaaataggctaagttataatctatcaaactatggatcaagccaccgatacccatcaagacaaacaagaagtagtaaaaattgccatcaaacgcggtgcctggtacattgccggtaaaatagaaaacagctacaacaagcatttccacaatagaatggataaggccaatcacaagattaaaggcttgaaaacgagcattgaataatgttggcttgccgttctttaataaaatacttggatttttttgtaaataaaatgccccgatcacggcaaaaacaacgtgcgacaatgcccgcaaagcaatgatcggcggtaatgtgataaaaaagccaaatgtggtacctaaagctactgctatcgccatccctggtgaaaagaacatcgccacaaacaatggcacatggctagctaaagtaaaggaagccggcccgatgacgatcttgggcatcaccattggaataacgattcccataccaatcaaaagtgctgcaatcgttaaatgacgtactgaatgtttcttcatgaataattcctccttcaatgtgtcttgacacatttatctcgctcattgtagcttgaaaacaccaaggtgtcaagacacaaaaaaacaggacgatgacctaagtatgaacagacaaaaatacctgaaggagataaggtagcgaattctgttaaaagtgccccttgaaccaacgatacggttggaataggtcctttcccctttccttcagatattcagtttgttgcctcacttatgccacagcccctgctgtttcattattcatttatttcaagtccctttttgtgcgccagcatttcattgctcaaacgtgcgaattctgctaatgacaatgtctctccgcgacgagttggatcaatttcactggcagctaaactcgctttaagccattctttcgttttttcatcttttccataggaattctgcaggttattccacaacgtttttcgtcgtaattggaaggctgccttcgtcaacttgaagaattctttttcatctgttacttcaaccgcaggagttgcacgacgagtcagcttcaagattgcggaatccacatttggttggggcacaaaaaccgtcttagggacaatgaaagcaagctctgcttccatgtagtattggacagcgatcgataaagagccatacgctttcgttcctggaacagctgaaatacggtcagccacttctttttgcatcatgacaaccatttcttggattggtgcctgtgattctaagaaatgcatcatgatcggcgtcgtaatatagtaaggaagattcgctacgactttgattggccgttcatcggtaaaagcttctctgatcattgtagacaagtctgcttgtaaaacatcttgatgaatcacttgaatgttcgaataaggagccaatgtatcttgtaaaactggaatcaaacggtcatcaatctcaaaagccaggacttgacgcgcatgtttcgccaattgctcggtcagagcgccgatccccggtccgacttctatcacatttgtttgatcatcgattgcagcagtcgcaacgattttgcgcaaaatattaggttcagtcaagaaattctgccccaggctctttttgaaggtaaagccatgttttgctaatatttctttcgttcttgatggggttgcaatatccctttgttctttcacaattcttcctccactatcttcattgcttcagccaattctgtttcagtaatacgaaacatggcaagacgtttttccaactgtttggcattcgtataaccgattcgtaaaacatctccgagtttttcccgttttgctcgtgcttgctcaccagcaatcagtccatagcttgctaaaacttgacgagaaattttctcactctcgtcttcatcttgttgactggctggcgtgacgactttgcgaagtgcttctctaagcgcttcatcactagcgtgttccacacctaaactgccctttttctttggtgcagcttggcttcgaggcaaaaaggcatgttgggcagccgggacagcttccattatgattttacgaattttttcacccgaaaaatcagggtccgtaaaaacgatcacgccacgagtctcttgggcatgttcaatttgacttaagatggtttcgtcaatcgctgatccgatcgtttcaatcgtatcgacatcaaacacttcttgcaatcggcgcgtatcgtctttcccttcgacgacaatgatctcttcgattctccatctatccttcataaaggttgaacaacttctcagcattgatacacgtttgcttggcgacttcctcaaaagacatctgacgcagttccgcgattttttcgactacatagcgggtataccctggttcattgcgttttcctcggtaaggcattggtgcaagataaggtgcatcagtttcgactaatagacgatcgatcggaaccacttgcgcagcttcttggacatccaacgcctttttgaaggtcactacaccactaaatgaaatgtgcatacctagatccaaaaagcgctttgcccattcgccatcaccactgaaactatgcatgatgccgccgatatctgtgattttttcttcttttaaaatctggtacgtgtcttcgatcgcttctcgggtatgaatactgataggtaaatgcatctctttagcgatcgcgatttgccgacgaaagacagccgattgtacctcttttggatcttccatccaatgatagtccagtccaatttctcctaaagctacaactttgggttgtgtcaggcgctcttggatgaatgcctcaatctcttttgtgtaagatcccgcttctgttggatgccatccaatgatactgtatatcccatcatattcttgacttaatgccaatgacttttcaatcgtaggttgatcaaatccgacaactgccattttcgttactcctagctcgtgagctctggcaatcgtttcgggaatctcttcattaaattgttctgcatttaaatgcgtatgtgaatcaaaaatcataaaacttcctccttgtttcctctatactctagcatattttgcggctttaagaaacgaatccttcttgttttttcatttgctaaagaaagttttcagcaatcaagaaaaatcagcccaaaggtggagggagaaaaaaagccagtcgattataatagacctatgatccatcagattcggaggtgaaaagatggaaaaatcaaaaccatttacaaaatgtactttacggcaacgctatcactattatcgtcagcaaaatgctcatcaacaatttaacgggaattttcaacaaaacttccaaaaagatttcccaagttttgctaactggcttaaattgcagcaaaagccgattgccaaagatcaaacagcgacattttctcactggttcttactgattctatttagtttagtgactgtagccacatttacccaacagctcttatttcttttatttgtttttgtcattgcagcactagtcaaaggtcctggaatgattctctggggagttgtctattcgtttctagtgacactctttcctcctcttggtttgttgctttcagcgcttttctttctgctcactctcaggcagttgacaagaaacttgacctttatttttacagctgtgtacttttacagctaccctttcttgatcacagcgattcatcattttacaacattcgatgatcaatggatcatgattgcagcggttatttttgccttgatcagcgggcatcttttgtttaagcgaaattatcagtttgcctctagtaaagcagttgcttggcgactgatcaccactccttatgattgtttgactgcattgattccttcaaagaaaggacgccgattacaacgactgcgaaacaaatgatttttcggaacctaaagcttgattccacgctgacattgaaactgatttgccaacatttaagatccatgcctagtggaaaaggacgcggacatgaacacttagacttcctacaaagggcttctgcaatgcaggagcccttcgcctattatttaagatgtgcttgactgctgctcttgttatctaagctggatattttcatcgttaaacaaaaacaatggaaaaagtaaatttgtttttttattttttgaaaatcaataaaaaaaaggaaaaaaatttttactgaatgtcttttgtttgattgcttttttggggtgaatctactatgctattagttagctaaacaaaaaaggagacccgctatgctgaccttcatttttatcttttccttccttgtgggcttgcttttttacgcctttattattgagccgcgccgattaaaacagcggcattatttgatcaaaaaagaaaagcaaacggtccttgatatttccaaagcctatgatctttatcaaaatgaacagaatgtagtagtcgcacatatcagtgatctacacttttctcgttggttcaaaccgcaacgcatcaatcgtatcatccgttccacgatcttaaacaaacctgatttgatcatcatcacgggtgacttgatcgacaattaccgtaagtggcctcaccgttcaaccagccgcctcattgaaaagttaaagaaattgaatgcgccaatggggaaaatcgctgtattaggaaatcatgatcatttgaatgatgggcaatattttgtgaatgaagtgtatgaaaacgccaatttcaccttgttggacaatgaatctgtatttggttctgatgagaaaacctcgatgaatatcgtagggatcgatagtgcgagcaaaagcgcccactaccattacgagccaaccttagcagaatggcagattctcttgatccatgaacctgactatgtctctcgagtagacaacattcgtgactatgatctcgttctatccggtcacagccatggaggccagattcgtgtgcccttttatcgtgcgaaaacgaaaggcgccctcaaatacacagatggtctctatcttttggccgcgaacacacttctaagtgtgtccaatggtgtggggaccacggcgattccagcgcgctttgctgtgccgccagaaatcacatactatcatctcgtgcccgccgaaaaacatgctgtagcctaaaacaagctcttaagtgatcctcctatctcgtttggatagttaggatacttaagagcttgttttcgttattggcgtaatccgttatagatcgtctccaaattccacttcatcatcgcataataactatcgccatcttgtccaggttcagcgatggagtctgtaaagacagtgccgtagatcggaatacctgaatcccgagacacgctttgcattgggcgagtattaacgctactctcgacaaacaatgaaggaactgccgatgcttgcaattggtcgactaaattcttgatctgagcaggcgttccttcttcttcggtgttgatttcccagatataagcggatggcacaccataggccttcgaaaagtacttaaaggcgccttcacttgtcacgatcaatttcttttcttcaggaattgaagcaaaattatctttcgcttgttggtctaattcggaaagctgctgcagatagtgttccaagttttcttgatagaccccctgatttgcaggatctttcttactcaattgttgggcgatatttcgcgcatagatcatcccattttccaaattaagccatgcatgaggatctgcctttgtatgatcagcatcatccgatagatacaggacttctacgccatcactgacggcaaaataatcttcacccgcttttttgttggcgttgttcattaatttagtaaaccagccgttgccgcccgtctctaaattcaagccattataaaatagaatgtctgcatcagtggctttttggacatcttctgacagtggttcatattcatgagggtcacgccctacaggaacgatgctgtggagattgattttgtccccagcgatgtttttggtcatatctgctaaaatcgaattggtcactacaacatttaatttgtcatcaacggttgccgcctgctctgcttgctgataaatcaagaatcctcctgcaacagcggcagcagaaaccattgccgtggtcagccagcgtttggcaggactcgtttgttgttttggtgaaaagagaaatcctaagacaaacaaaatagctgcagtgaggacaatgcttgatccggctgcaatattaaaggaataaccgataaataacccaatcacagaagaagcaccgcctagaatccctgcaatcaccatcatatggctaaggcgttttgtaaataaataagcagttgctgctggcgtaaccagcaaagctacaatcaagatcgtaccgacactttgcatcgcagtaacggaaactagtgtcaaaagcagcatcaacaagtaatgatatacctgtacattcattccaaaagctttcgccatcatcggatcaaaagaagtgatcagcaatggccgaaagaagatcataatcagtgcaatgaccagtaaagcaatcgcaatcgtgacccatttatccccctcttggactgcgagcacatttccgaataagatatgaaacaaatccgtagaactgttagctacgccaatcaagatcactcccaaagctaaaaaggagctgaaggtgatcccgatcgccgtatcacttttgatcaaactattgttagaaatataggtgataatgatcgatgcaagaacaccaaagaaaattgctccaacaaaaaagttcacccctaaaatataggataatgctactccgggaagtacggcgtgagaaatggcatctcccatcaatgacattccccgcaaaataataaaacaaccaatcacccctgcaacaacaccgatcgctacggcggtgatcaaggcattttgcagaaaatggtaatgaactaatccatcaataaactgactaatcatcttaagcccctcctttcacgatgatcgtatcgccgaatgtttctttcaaatttgtttcagtaaaaacagtcgtcgtcggaccatatgcgattaaatgctgattcatcatcactagttcatcgaagtattcagtcactttgcctaaatcatgatgaacaataaaaattgtctttccttgttggcgaaattcacgcagaagtcctacaataattgcttcactcatcgcatcgattcctacaaatggttcatctaaaaaaatgaattccgcttcttgcagtaatgtgcgagcgatcaatactctttggaactgaccgccagatagttcgccgatctgccgttcagcaaagtcagccatttggacagactccaatgcagcggcgactttctgccaatctttggccgttattcgttgaaacagagaaagctgcggatagagtcctaatgacaccacttcttttactgtaatcggaaatgtataatcgactgcagtcttttgttccacgtaggctatctttttttggaacttattgagtgccattccattcgatgtgacatgtccttcagaagggatcagctgcagtgcagctttgatgaaggtagattttcccgcaccattcggtccgatgatccctacaatggccggcttatcaacacagaaagatactccagagacagcttgatttttcccatcatagctggcggaaatttttgaaaatgtgatcatagtttgcgctcctttacatttatgttaaagtatcgtttatttattttttaggcatgcctaatttatttccaattataccgattctcctgttgaatgcaagggattttttacacaaataaaatccaattagaaaaaataaagtgtcccttcaactaccttgcccctagcagatcgttttattcattcgccgttacttttagtgtgaccaaacaaaaaaagtttccactcctttgagggaaactttttaaaagaaaactttctaatcagcattcgctgtttttttcaaaatttgtgatgaagaatcaacctggagtaccaattgtcggcaatatactcgtcactactcagacactacgttgactggttgattctctaagaaatgcttataatttgagacagcgatagctagcaatcgttgccgggtctctaatggtgcccacgcaatatgcggcgtcaaatagcagttaggcgcatgcaacaatggattgtcagccgtgattggttctttcgaaacgacatcagctgccagagcagcaaattgtccagctgacaacgcttctgctactgcttgttcatctagtaatccaccgcgagcagtgttgatcaagataacatcctttttcatttgagacaatgcacgggcgtcaatcatcctctcagtatcgggaaattgcggtacatggagactgatcacatctgcttgttgaaagagtctctccaacgaaacttgttctgcccattcagcctgcggcgtttttggtcgatgattgtaatagatgaccttcatttgaaacgcatgagcaatttcagcgactgcctgagcaatcgcaccatagccgatcaaaccgatcgtcttgttggcaatttcagtcagtggcgtttgccaataagagaaatcgggactgttttgccaatctccttgatggacggattggttgtgccgccctacttgattcgttacctcaagtaataaagcaaatgtagcttgcgctactgaattcgtactatagctgggaatatttgtgacggtaatcccttgagatgctgcagcttgtaaatccacaacattgtagccagttgccagcacgccgatataatcgatgttagggcatgcttgtagtatttcctttgtaaggggcgttttgttcgtaaaaacagccgatgctttgccgattcgctcaatgatctccttcgtatctgtataggaagtgcgatcataaatcgtgatttcccctaatccagctaatggctgccaatctaaatctcctggattcaacgcatagccatctaaaacaacaattttcatttttttgctcctctctgttggaaataaaagactggaatccctaaacaggtgatcaaaataccgatcaatgcaagcacaggggccgtaaggatcgtcattattaaaatgaatccgccccctaaaagagcaatgatcggtgtgatcgggtacaacggaaccttgtatggacgattgagctcaggtgctttttttcttaacaagatcacacctacaaacaataatacactaaaaaaccacatcacaaaaatcaacatatccgttaagagatcaaaactacccaacaacatcattaaacacgcaattgctaattggaaaaaaaccgccgcataaggagccttggttttatttgtcaatttaacaaaggtcgaactgaatggaacttcattctcgagtgccatggcataaggcacccgcaatccggtcatcgtatacccattgagtgcgccataaactgaaatcaaaataccaatcgtcactagtttgcccccaaaatcaccaaataactgcaatgcggtttctgaagcactatttaagtttccagcaatctgttctaagggcaatgttttcaagaaaacaagattgatcaggagataaaccaaggttacaaaacttaatccaaagataatcgctttcggaagatctttttccggccgcttcatttcaccagcaatattcccaacacctaaccagccatcataagcgaagagagtcgctagtaatgcactgctgattcctgcaatgatcgaaccatcacttgttgtagaaaaattgattaccgagactgacactcgtcctggtgtcatcaatcccactaaaacgatcaatgcgatgggaatcaatttgattgataatgtaaatgactgtacgcctgcggcggtttttgtccctaatagattgaacaaactaacactggtaccggtgatcaacgatagcggcaagagataacttgcgggcaaatgaaacagattcaaacactgagtggcaaaaataatactcaacgctgctatattggcagggaaataaataatgctttgagcccatcctagcaagaaagaaggcaatttcccgtaaattcgttcaatgtagcgaataggaccaccagtttctggtattgctgttgctagctccgctaccgttagtccgccacagatcgtcaaacagcccgcaatcaaccacacaagcaatgttaagccagaggattgcgtatgttggaccactgcagccgctttaaagaacaccccggctccaatcacagttcccatgactgtcgaaagtgctccgaaaaaagtgatttctttctttagttgactcttcaaatactcacgctcctttttttgactaaatcaaagtatagcggatagatgctttgttggctagagtgattcgtttggaccacaaaaaaacagctgcttttcaacagctatccctcttatttatttactgttgaaaccaaaacttgtgtacgcctttggtgcattcgtttcactaagaaaactgcaagcaacaagatcaaaggaaagatccccgctcccaaaattccttgctgcaaacctttgtcgctgccttctgccaacaaaccgaccaatgaaggtcccaatgaacaacctaaatcacccgctaaggctaggtaagcaaacattgctgtacctccattacgaatgtattttgtcgttaaactaaaaattcccggccacaatataccgacagcaaatccactcaatccacaaccgataaagcctagaattgggacacttgataacccgatcagcaaatacgccaccaagcatagcaataagcttgcaaacataaatttccgtagatcgatacgttcgccaaatttcccataatacagacgagcaagtcccatcatgatcgcaaacaacattggtcccgcaagatcaccgaccgttttggacacaccaagtccttgctctgcaaaagtggatgccgattgactaactgattgttcacttgccccggcacagaccatcatgactagaaacagccaaaagcttttcaatgagaacagttcacgattcttcagtcctacttcgccttctgctacgattggtgctaatggaacttgagtaaaaacaaccaaattgaccagcggcaaaatagcccagatcaatgtaagaaatggccaacgagcaataccgaagacaaagaaaaagagtgttgagactaagacgaccccaacatatccccaacaataaaacgaatgcagcatactcatggttttttctttattcggggttggacaagcttcgacgattgggctcactaatacttccagaagtccgccaccaattgcatagaggaagactgccgtcaataaaccggtaaaaggggtcggaaagataagtggaaaaacagccaacccaatcaatcctacagccgcaaaaaaatgcgccgcgacaatcgagatacgataaccaatccgatcgacaaaaaagatcgctgcaaagtccacacccagctgcgttagaaaattaaatgtaaccaaaagcgtgatttgacttagcggaatctgatactgtgtttgaaatgtcaaaaataataaaggtgcaaagttattgatgattgcttgaacaatatacccagcaaagcaagcaatgatcgttcgttgataatttttcatttttacctcctccagatttgtttagtatagcaagagaactttcacaatcgccatggaaaatgctattcaaattgctagagtatgttctcttttttggtgtattatcagttgaaaattgctccctactggtattgcaagtcagatctcaataaagttagtggtgataagtgctagtatcataaaaaaaaacgaatctcccctgccgatttcagcaatctggaaatatcgtttttttttttgaaacacaacgattgaagatctctactggctgaagatccttggtcattgtactaattctgtccaaaagttcttttattttgaataagttgtccgaaaaggattatacttgcgcttttcagagacagcagattagttggaatgtgctgccagcattttgactgtggcttcaaaaattggtccaataaagatgatacagagcaatgtaccgataccgacattggcacccaaaccaaagccaatcaagaccatcgctgcatccaagccgatccggatcgtcttttgggtcagcttcgtacgtttataaatcagcgcagttagtgcttctaatgctgctgatccttgatttgaagagacatagatccctgccccaacgccgaacaagatgggggcgatgaaaatcgccaaccaagaatagaatggcaaatgaacaaaaatcttatccataaccggctcaaaaatcccaatcagcaaaccaagaccgatcccattgatataactgccgattccaagctcctggcgatcgaaaatagctacgatcaataagacgaccagattaaaacatagactggcgatccaaaacggaacagacacatgattcaagattcccagcaaaaatgtactgatcgtatcatacccctgatgggcagtgatcagcaatgaaattgctaacgcaatcaaacacgtacctaacaagatttgccaaatttttttcacgacatcactctcttttccaatttagttttctagactctcttagtgtaccttgccgtttcagagattactactatttcttttatctgtctaaaaaacccttcaagcggtcaatccagtgattcgtaactttgctcatacttctctcgaaattcttttggcgtcagaccattcaatttcttgaacatctttgaaaaataattcgtattattgtatccgatcacatcggcaatctcattaattgtttgtctcgtatgcagcagaagctgctgagcttttttgatccgaataaaattgacgtattgattaaagcttaattccgtttcttttttgaacacttgccccagatagactacactaacatgcagagcttcggcagccgatttaaccgtcagctcttgtgtatagtgctcttcaatcatgccaaccgctttttgaacaatctcagaataacgcttttgctgaggctggtctttggccaactgcaaaatctcgttgaagagctgacgcagtacctggatcgtattcgatgctcgaatccgagtgatgatccgatcataattttctctagtcaaagcagggaactggcggtaaatatcattgaataatagaaaggctacgtaacggacatgctcagggtcagcctgcatcccctcgagacttgaaaagattttgtctaattcatcttgaacggtttttgtatccccgatcgtcaatgctttattgaaagagagaaaaggtagcgcttcgttgcggtctaagatatcgacttgaatgatttgttcattaagcagcaaatccgggtaaaagatctgcagtgattggacttgcttgattttctcataccctttgtataagttttcccattcattgatcgtttcactgaccaccaattgccaatttcctgctagaatcgctgacagttctttgagcagacaccagagacgttgacgttcaccataaaaaacgatcagcaactgattctctcccaatcgtcctggcagtagcaatggctgttctttttcgacaaaaaaacgaaacccattttctaagatttcaggtgtccctgtcagctgtagaatcgtataaggcggatggatgggttgtgtggactgttccaataataagtggtactcactttcatttaattcatcattcagccaaagcaacaagctggattctcgatacaagtcattttgttcatcgattcgttgctgatgtgccagttcctccgcaattgcctgcacactttcatagagttcgaccttgttgactggcttaacgagataatttcggactcctaactgcatgccttgcttcacaaatgcaaattcttggtaaccagataagatgatggaaaaaaaggtattgccttttgcctgtgctttagcgatcatatcaatcccattcatttccggcatgcgaatatcagtgatcagtagatcaatggcttgtgtttctaaatattccaacgcttcagaagcgcttttagctgtgtgaacgacttcaaagcctaattcttgccaaggaatgatcatctttaggccttctagaatcatgtactcatcgtccacaaacatggctttatataaactcatcattcaacatctcctcatcgatcgcaatggaaatcttgaatccgtgatttttttcagattcaacttccatctgataatgatcgccaaacatcccccttaatcgttcatgaacatttttcatgcctatggatgtttgtacgacgactcggtcatctgcaagctcttggcggatcatcgctaattgctctggatctgctccttttccgttgtcccgtacttgcaaaagaatcttgccattttgtcggaaggctttgatactgatggcattatcatttcgctgatagtcgattccatgcacaaaataattttctactaaaggttgcaaagtgaacttaggcaagagcagatgtttcagatcttcttcgatagttacgtgataggcgattttatccggatacctcatttgatacaagtaaacgtatttctcacaaaacgtcacttcttctgccaatgttttgatcttttcctgtgtcgtattgttgcgcaaaagtgccgaaaaagcgtatacgacatccgctaattcttcctgctggcggctcaatgcgtacatccgaatgtattcgagtgtattgtataagaaatgaggattgatctgagcctgcaatgcccgcatatccgcatcccgctgcttgatttccagggtatagatgtcctcaatgtagtcattgatactgcctgtcatttgattgatcgcctcggcgattgtttttaattcttgttgaacccccgtggtatcaatacgctcattaaaatctccgtgactgactttttgggttgcttgaacgatctgtttgacctgctgggtgtaacgcttgaacgtacgatgcaaaatcaatagcagcacaaaaagaatcaacgtaccgcaaccaaaaatcaacaatgtataatttaggacatcccgccaaatcgcttgcttatctagtaaaaccagcgtgatttctccgttgatattcccttgtttttttatgtaaaaatcatgggacaatttcggcacgatctctttttgattattggccattgcttgatcgattttgtcgatcatcgcctgattcagattcggtgcatctttatagagacgctgtccactgcttgtgtatatgaaacttttgataccgtgttctctattttcatcactacgattagctaatacgttttcttcattaaataccacaaacacttgtcccattggttgcgcaaaattactcggttgtgcgatcgatcgcgcaaaatataggcgatttttcaattggatctggtcgccccgcagtttctctccgtaaggtctgtctggtgtagcaactaaatattctttgctttcatccaattgaacgatgatttcttcaatgtcaggatgactgctgatcaaacggtaaaggatatttggcagataaatattttgtcctgattgtcgaaacatatcattactataggaaaaataatcggcgatcgataactgtaaatagttgcgcaatgattcaaaggtggcatccgaactggtgaattctcctaatacttcagaaacaatcgtattacgctcttggatatacgtatctaaatacgtgcttgttgcatcgacgagtcgattactcatccgaaaccgatccacacccgtatagacactcaaccctaacatgatcaaaatcgaaatcagaatcaacaaggcactataaagctgcatcaattgattgatcaggaagtcacgcttgaaaagggctaagattcgtttattcatattgcagttttccatcgatcaatgcacggtctttccgggaagcggaatggacccataataagatcaaactgaaggtaccaaataaaaacaatcctttcatgctccaagtaaacaccaaaatacctacgagaccaaaaatgactttagcgaaggtgccaaaatttagaaataaactgacaaatgccagtttgatcgtattcaataaagaggtttcataaattgattcaaacaataaactatacaaatacagtaaaaccaagagaccacttactactactagcaaaaagtcgatcatcagccacagtagtccttggatctgactggagagatacaaattatacgctgcgatcgccagcaaaccgaaaaataaataaaaacgggcgttggctcgccaaaagttttgcttccagcatcgaaaggccttcctaaacgtttggtcctcgtaagataagccctcttcttcgatcaaatcactgatggtttgaaatgccggaccaaccccaaacaaaactgcgcccatcattgtaaacaatacgaagaaaagattcagtttaatgaccgcccaaatcagacgaaaggcctttactaatcctccacttgttgtctctttcattctttctcatcccctcttggtatttgcccgttttattatagcgtttttttgtcacttctcaaaatgcgaatctttactttttctgacgcttatcgccgcttattctatcttattctattatgtacaacaaatgaggagtgacgaaatcattcatcggctactcctcatctgctcctacgcgcagttgctccgcttattttaactaattattttccagattcacggtattcgtcgaattgtttttgcatttcatcacgaactttgtcccaaccagctgttttcaattcttccactagttttggcacattttcttctggatcaatcgtccctgttgctagacttgctttataacgattcatgacattggcgatgttggtgatttcagtcttcacactatctgttttaaagttgaaacctagaatcggtgattcttcggctttagcaatgttttcgtcacgttctttgatcatttcatcagtgatcgattcttgcgtatacaagatcatattgttcccagtattccatgccgccatgtgagtgtttggtttgtaaccatccaacaatttgattttgttatcttgcccttccactttttcccatgcttctccttcaacaccccagacaagtccattcaacaattcagggtcgctgtttaacaaaccaaggaattcgacagctttttctttgtttttagaaacatttgccaccacaaagttcgccatttgggcttgccctgttgatttcaattgtttggtaagcggacgagaaatcaattcgtgaccggcagcattgttcaaaattgtatcgccgtaatccattggtccttgggtttcttcacgcatgaaccaagtatttccttctaatggatagccagtggtattggttgcggcatctgttgggatcaatccttctttataccatttgtgcatcaatttcaagtttgccatttgttcgtcatcttcatatgggttgatgatttttgtagtgtctccgtcaagtttgaccgcaaatggatagtctttccccatgacatagtcatagtttcctgaaatgttgaaggtttgaccaattgcgaagctggcaatattcggttccttctcatggaattttttcaaggcatcttctgcatcagcataagaattgatattgctgatatcaatgtcgtatttatcgagatattgtttgttgaatgtcaatacttgttgtgcatacacgtttccattaacaggaaaggcatacagcttgccatcgatggtgttgcctttgatatatgcttcatctaattgatcataagcttccttagcatattttggtgcgaggtcggtcaaatccgcatatgctcctttttgggcatttgccacaaaattagatgcaaaagagatatcatagttctcgccagaagaaatgatcgtactcattttttgatcccaatcgccccagccaatgtactgtaggtcgatccgtgcattgattttttcctcgatccgtttgttggcgatctccatcaattgatcaaagttctctggtttgtccccgacttgatacatcaacaaagtctttacgccatccgcactattagaatcagaatccgacgactccccgtttgacccgcaagcagctaagctcaacagcattgctgaagcgaatcctgcaaacattgtttttttccacgatttcatttgttttcctcctatatccttattattctttgacaccgccaattgtcaagccacccacgaaatatcgttggaaaaatgggtaagtaatggcaattggtaatgttgctactacaacgattgccatccgagcagtctcgtttggcaatgcggccaatccaccttgaacttgagcagccataccggtacttttagctaaataatccaagttcgattgaatccgcatcaatagtgcttgtaacggcactagtgaatccttttgaatgtataacaatgcattgaaccaatcattccagtaaccaagtgccgcaaataaactgatcgtagcgattcctggaaccgctaatggtaagacgatcgagatgaaaatcttcatttcgctggcaccatcgatccgagctgactcaataatactgtctggcacagtcttcttgaagaaagtccgcatcactaaaatattgaaaggacctaatgcaatcggtaaaatcaatgcccaaatcgtatcttttaattgaatcaaattaaccattactaggtaattggctaccattcctggggcaaaaagcatcgttaccaatgcaaagagcgtaaagaatcgccgaaatgggaaattggaacgagaaatcacataggcatacagtgaagtcatcgttgcattgatgactgtcccgaagacggtgataaagacggagatcccaaatgcttgaaaaatcttgctgctcatggcgccactaaagagatagctataggcggcaaaagaaaattcaccgggccaaaagcggtagccattctcagctagcgaggtttcactcgtcagagaaattgcaattacaaataaaaatggtaagacacaagaaaaggcaaatagcgccaaaacaatattgaaaatcaggttgaccgttggattaaaggaacggacttcgacctttgctactttctttttcattcgtccatcctccttagaataatgctgaatctggttctaatttacgtaccactaagttggcagctaagagcaagcacatacccactacggattgataaagtccggcggcagcagtcatgccaaagtcacctgtggccgtcaagccgttatagatgtaggtatctaaaacggaagaaacttgatacaatgcacctgagttgcgaggaacttggtagaatagaccaaagtcggcccggaagatcccaccaatattcaaaatcaataagacagagatcatcggcaataattgcggcagtgtcacgtttttgatttgctgccatttattggccccgtccaccattgctgcttcataataggtttgatcgatacccatcaccgatgcgtaataaatgatactgttgtagcccaagctcttccagacgttcatgaaaacaaagataaatggccaccattttggatcggcataccagttgattccttcaccacccatgttggtgatccattgattgataattcccttgtcagggctcaaaaaggcatagacaaaataggaaataactacccatgaaagaaaataaggcagcaatgacatggtatgatacactttgaccaatcgcttgttccgcaattcactcatcacgatcgcaaaggcgatggcaaaaaatagattgaatgctagaaacacgatattgtaaagcaatgtatttctagtgatcagccaagcatcatttgatgcaaataaaaatttgaaattatcaaacccgacccacgggctctgttgcagactggcaaaaaatccgtctggtgaaagacgaaaatctttgaatgcaacgacattgacaaatactggaatatagaaaaaaaagatgaaccaaatgacaccgggaagtgccattaagataagtgctttaaattgccacacatttttccaaaatccctttttcttcacatttgatcaactccttctgctataagaataacgctttcattgtgaataattaaggaacaaactaaagataaaaagaaacaaattaaagattttgtcttttctattatcttttgtatgattttccccatcgatcaaaagacaatttttcttcacaaaaaaacaagcagcacgtattgctgcttgttttactttttttattgggcttcttttcctaataacagactgccaataatgccgcttttgttcggcagcccccaagcaacaatgtattctgtgactgtcggtgtttccatgtaaccagccatttgctcagtaaactgatcgtggattttcgtcaaaagatgcggttggttcatcactccgcctcctaatacaattcgatcaggggcaactgtcaaagtgatattcacaagtgcttgcccaatataaaaggcttgtaaatcccaaatctcatgatcttttggcaaatgttgtcctttgatacctgtccgtgcttccagtgagggaccagctgctaacccttccagacaatctttgtgatagggacaggtgccgacataatcgtcctgcggatgccgtttcacaaaagtgtgcccaacttccggatgacctgcgccttggaagatttcctcattgattacgattccagctccaataccagtgccaatagttagatacacgcagctgcgcattccttgtgctgcaccttgtttgagttccccaaaagccgcagcattgacatctgtcgtccaggcaaaacgagtggcgggataccgttttttcaaagtccctaaaaaatcaaactgctgccagccttttttgggtgttgctaagattttgccatacgtttcttgttgaggatcgatcccaatcggaccaaatgatcctacccccatggtggctaaggtgtacttatcaaaaaaagcaaaaatagcagccatcgtttcctctggtgtcgtcgtaggtagtgagcactcatcaatgatagatcgttcatcagcgaccgcacaattcatttttgttccaccggcttcaattgcaccataaaacatctttttcactccttcaaaccgattgttcgaatttcataagcagccagtgtttctccaactgattgaggctgttcttcttccaacaaattaagcaggcaacgatctgtcttttctttcttcgcgacaaaaggtgttgctgtatcggcaagattgtaccctcttagaacgagcaagtcatcttggcgacgacgtttaagagccgtgatcgccactgtagcgccattggcttccacgaattgtgactgtttttctaatagacctgagtggatggctgtttgccgggcgatccaaggcacttgagctgcttgtgcttgtcgataggtttcgtagcgttcgttggcttgagcatgcaactcaatcccgtactcaaacgtatgcttaccgatacattgcgcttctggtgttgggaaatagccccaatcgccaagttctcctgtgcatcgtaacaacgtcaaacaaattttgtcttctacgatctcgtattcatttaatccagtattggaaactgtgacgccgaaatcttcctcatgtaaattaacaaatgcgtgttgatgctgcggatttgtcggattttgccaatgactagagacttgattcggccttctaactgcttcatagatactatcagcttcatgttgatccgtatggatacccgtagggaaaagcgcccgtaaccggtggtctttgctttggttgttcactgtcgttttaaaactgattcgtttactgttgcagtccaagcgaatttctgtttccaaggtaaatggcactgtttgttgcgccctttgtgctttacggaaacggaaatcaacgactgctttttgttcttcaagtaattgctcatcagccgatactggaatttgcatcatctgcgttactttaacgacgccataaagagcagaatttgcgatgacctcaatttgatgaggaaaagctgttgagtaaatggcgcggtccccttcaggttgtttgaaaatatactcattgccgatatcgccaacatcttcaaaaaccaataaatccgtcaattctttcccggttgctttttctttgatggtcagactgccgtttgaagtgatcgttgcttggacaaacgcgttttctaaaacacgaccatctgctgaaacgattttttctgtcgtagatgctacttgtggcttgtcagcctcaatcagtgcaaaggtctgccatgaaaattccggcatttgatccatttggacttgtacattgacaaaacgcttcataaaaggaatccgaaaagcgtctttcggtaattcatagtcaaaaagcacttcttcttcgctgatttttgccggtaagatctttccttcagaatcaatgatttggtaagaacctttaggctgttgctgcaactcttgatataaccggctaggaagcccttctcggaatgttttccggctcagttctacttccacttcaacgatgcccgaacgtgtcgtccctgaggtattaaagactacaaatggtcggctttcttttggaaaagcggaagtatcgatggcatttagcaactgtgctactgcttcatcagcgacatatttgccgatttcattggctttttcaaaccgcggcatcatctcccgatgcacttcgtccaccgaacagccacaaatactgtcatgaggatgattttgcatcaacagtttccaagcgtggtccagcacatcgtggggatacttcttcgttacctcatacgccatcgttgctaatggttcagccacattttccaattgacgtgagacgcgcgtattccattgtttcaaataaacccgcgaggaggccgtgttggctagcgtataccagccgtctgtctcttgacttgtcaattcgccgctcacggtcccaaggtctgctggcaaatccgcttgaactgctgcaaggtattctgtgaacccagcatgcttgaattcataatcagggaacaattcattcgctaagcggatcgcttcactgatatttttttggacaggctgatgatccaccccattcatcatcaagtaatgatttgtcgaaccaaatttctcaacatcttgcaatttttgagtccaaaactggtgtgcttcttcccgatcaaccggaatctcattgccattggaataccagttggcaaaaagtagaccaaagatctcactgccatctggacctcgccaattcatttctgagtattgggaggtaaactgatcatccggtaaaacttcgttatcaaacccgattggcttaactcctcgaccaaaagctgcactgtgtaagttggcttgcttcatcatttgcggtgtttggcccatattcccgaatgtatccgggaaatagcccagcatgacgggtgttccccattttttgctttcagccatcccaatcaacatgttgcgggtattggactctgaactaatcaaaaagtcatcttgaagaatataaaagggaccaatttgtaattttccttgatcgattgctcgtttgaccgctgcccgcttttccggacgaacttccaaataatcatctaggataatggtctgaccatctaaatgaaaactgtggaactcaggatctttctcaaacaattccaatagatcatccatcaattcaatcaagcgcatatggtgttgctcataaggcatataccactcacgatcccaatgactatgagatacgatataaatttgttttttcattgtctaactcctctcgtttttgccggagatgcttatttttctactcgaatatcaaagtaatccatgacaagctcacaaaacatcatattggcccatgagaaccattcccgggtatatttcgtcggatcatccacatcgaatccttcatgcatcaaatgggtgccagcatcggttgcaactaattgattgaggattcgttctttctccgccttatctggtgtcgtcatgccttccattgccatcgcgatcggccacacatagttttctggtgtatgagagcttccgattcccttcgcatattttccttcatagaagtaaggattttcggaactgagcaacgttttgcgtgtggctaaataggtttcatcttgatctgatccgtaacctaaataaggggcggcaaccaaattcggtacgttgctatcatccatcacagtggcattgccttgaccatcgacttcataggcatagatcgtttgacccgcttgattggtggttttgccaaacgcatcgatccctgcttggatctctgattggagctgttttgcttgagtaacaatcgctggttcattcaagatagaactaaaaatctcaacaatgtagcctaaaaccactacagcaaacatattcgaaggaaccagataaccataagcacatgcatcgtcactgggacgaaatcccgaccaggtcataccagttggtacgacaggcgctcctttcccgtcattgatcaaggtatcttctttacgccatgtttctctctcaaagcgataaggagattcttgatgattttgttccgtggcaaaaacatgaagggcttttttgataccgctcacaaaatcgtcattaaactgatctgttctgccagtattcttatacaacaggtacgccaattgaatgggataacacaaagaatcgatctcatattttcgttcccagatccaatcattcatctctgtcaaatcgctttgatgcccggcgccatttgctgcttcattaaaggcattggcataagggtcgatattgatataaaaaaattgcttcttgactaatccgctgatcatcgctgccagctcttcatcttccttggcaattactaaataaggccgtacctgcgcggttgagtctcgcaaccacatcgccggaatgtcccctgtcagtagaaatgttgtgccatcttcatggcgtttgaccgttgtcaacaatgtgttagcaaaagcagcattgaagttttttgcccaatccgcatgttcacttccgcaacgttcggttatttcctgcataaagtttgcaactgaatttggtatttcttgataagccatttggtcaccgtcctaaatttgatatatcattttacgaattcagtataacgatgtttctcagcattgtctagtgaaatttgacaaaactctattttcaattttgaacgaatatgctatcctgtgaatatgatatatcaaaaaaggagatcaactcatgaaagaaccattatacaaaaaaatttatcacgaattgtatgagcagattcaaagcggtgagttagctccggaaagccgtgtccctactgaaaaggaattgtcagagaaataccaagtgagtcgcatcacctccaagcgagccttaactgaattggaacaaaatcagctgatctatcgtattcaaggaagtggcagttttgttcgtagaccgatccaaccacaatcaaaggggaaagtgctgtttattttacccttcgcgaatgacctttcccttggcaattttacggaaggcatctatccagtcatgcaggaacagggattcgaattgatgctgacacctgttgattatctggagcaaaccacggccgaagctttgacagaagaatttgacggaatgatctactacgctaacaacacgaattcaaattatgatctgcttttcgaactggcttcgcaagggttccctgtcgtcacacttgataaagcactgcatgagttctcattcccagctgttttggcagacaactttgaaggaggacagttagcgactgaacatcttttggcacaaggtcatcaacgcattggctatatttttggtgaacgtcaccatccacagtctgtccgccaacgttatctaggctatgtggatcaattaaaaaagcaacagtcgtcttttcgaacaaaacttgatgatcctcaggcacttttgtcatcagctgttagttatattcaagagaatcagttgactggggctgtctgcgagaatgatcttgtcgccatcgaattgatgcgccaattgaaacaagttggggttcaggttccaaaagagtttgctgtgatcggcttcgatgacattcaagcggctgcattggtggatccacctctcagcactgtaaaacaaaattttgccgagttgggtcgtttggctggtacaaaattagtacagttgattcagtcaactgctgccgacttatctccgctcgccaaagaagatgagtctgcaacagcgaatcagaaagtcgcagtcactttagttgtcagagattcaacaattgaccaaaaacaatgacataaaggagcaaacaaaatgaaagtaacaatgatcgatacgaggcatgggacagataatcaatacagcttttctcacggcaactgtctcccttatacaggggttccgtttggcatgaactattttgcccctcaaacaagcgaccaacgtggaagttggtggttccatcctgaagaccgtacgtttcaaggatttcgactgacccatcagccaagcccttggatgggcgattttagtcaccttacttttttgcctattaatgggaagttatcagaaaatacactatttcatgcccaaagttcctatcgtccagaagaaagtgtcttcaatccagcttgtttacaagtgaaaagccaacgctaccaactcactacaacattgatcccaagcatgtacggaggcattctggctctagatggtgcagtgactgatcctggcttaggaatctctttgcctgggcgctatcagctgcagcaagtcgacgaacagaccgtcaaaggacaggtcatcaattactctggttgtgaagacaatgactttgcttttcacttcatcttgcgttttgaaacagctgttcatgcgattgaaggggaattatcaggagaaaatggctttgtggtgattcgttttgaagaaaaaaatcagcaaacgatccgttttgggacatcctttttaagttctcagcaagcctttctgaatctcagccgtgagttggatcaaacaacaactgactacttgtctaatgcgcagcaatcatgggaaaattacttgaatcgaatagatatcaagcaccacgatccaaaacaagtttcaactttttatcataatttttatcggttgtttttattcccacagactttttatgaacgagatcaatctggtcaaaaaatccattacgatacacttgccaagaccatcaaaccaggaccgctttatacaaacaatggtttctgggatacttacaaaacagtctacccactcttttctctgattgcggtcgagcagctagaagatatgttggaaggatttttgaacagctttaaagaaagcggattcttgccaaaatggttatcacctgatgagcgagggctgatgccaggtacattgatcgatgctgtgatcgctgatgcctgcgtcaaaggaattcgacctgacttgatgccagagctcttaacagctatgaagaaagcagcctccattcagagtccaaatccaaattacggccggcaaggaactgccgattacttgaaatacggctatgttcctagtgagtaccatgaatctgtcaatcatacccttgattattgttacagtgatttttgcattgcccaagtggcaagttctctggctgaccctgaagcaagctactatcagcagcaagcaaaaaactatttagcgatctttgattcagaaacaggctttatgcgagcaaaagacaaagccggtgattttcggacggattttgattcctatcgttggggtcgtgattatgcagaagggagtgcgtggcaaagtagctttgctgtgttccatgattttgctggcctgatcgcagctcatggcggcaaacaatcctttgaacaaaaactggtggatttgtgcaatcaagctccccattatactaccgagggctacggttttgagattcatgaaatgagtgaaatggcggctttggattttggtcagttagctatctcgaatcagcctagtttccactatccttatctctttagttacattggcaaaccagaaatggcacaaccattgattaaacaattgctgacccaatgtttcgatgattctccaaaagggtatcctggagatgaggacaatggcagcatgtccggttggtatgtttttaacgcattaggtttctatcctgtcactcctggtaccggcgaatacgttttggggatgcctttgcttgacgaagcgacactctttttgtcgaatggaaaagaacttaaaatccacagcacgccaaatcagccgcagcagcaatttatcgacaatgtgactctaaatggtaaacaacactctcggttgttctttactcatgatgaactgatcgctggttcgacgatccgctatactctaggcatcgttccccgcagtaagacttggtcagcggaagcttatccttatagtctgtcgcatagtcaagagtcgaatgaagaccataatgaaaatcggtaggtaccttttttaaagaacgagcaataccgaaagaaaaaaggttgcgacataaggatcaaccaaactaaactatctgaatgacagtaattgaattgcgcgaggtatttcccacttatggagataccctgctgaccgccggacaattacaacaaccttcagatagtcagtttgttgaagaacttatgttgcagaccttttttgctggttgctcttttgcagctatcaatcaatgaaccgatagcctaaatcgattagatcaatgattagattcctgtaacgccaaaatcagttcaatggttcgcagcacaccattgtcatcattggagcgggtcacaaaagctgcagcttccttgatttcctcaaaagcatttttcattgcaaagctgtaggtgccagcggccattaattcgctgtcattcaatccatccccaaagaccatcgtttcttggggactcactgccagcaaattctgtaattgggctactgttgtccctttatggacaccttgattagtgatatcgatccacgcagcttctgaagcaacgatgtaggcatctgctgcaaaagaagacagctgcttgacgctatcgatacaacgtaacttaggatcatataccgtcactttcacgaagtcttcttggatctcactataactggtgaccgttttgacaacacgataagaacctcgaacccgggctgcattttcttccgttgtcgtttccttgatataagcggctgttggggtacaggcaatgatcacatggtcatctgctattttttctaatcgttggatcaaacgctgccccaatgcatttgggagtaaggattcaaacacatagcctccttgatgtttgattcgtgtggcactatcccctaatatccagattttcgctgcttgatccccaaacagttcttctacgcgctcgcactgcttgccagtacaagcggcaaaggctatccctctttgttccatcatctggctgactttatcaaaataggtttgatcaaaggccccctggctatttaaaaatgttccatctaaatctgtaatgatcagtttgatcatctcattccacatccttcgccgcgtcgctgccgctctatttatttaactaccttaattaaatatacttatttaactgaaaaccgtcaatcgctttaggaactttctttacattgctgcgcttcatcgctatacttaataaactaggttcactaaaggaggcaataacatgtctgccaataaaaacttgattcgccaccagaatattcaagtcgtcttaaaagaattgtttcaaaaagggacctcttttgcatccgatctggtaaaagagaccggcatcagcatggtgacgataaattctttattaaaagatcttgtttcagagggaatggtaacgaaaggcaagctcgttcaaagagagattggacgcccagctatcgaatattgctttaactataagtactcaaaatcattgttgctcgctttgatagaagtaaatcgtcaattggagttgagaagctaccacatcgatttgaaaggaacgatcttagctgcgcagcaccaagctttttccgagatcacaccgacagcctttcagaatcttgtccgacaatctatcgaagctttcgctgatgtcgaacagatcgctgtgctgttgccaggaaaaatcagtgagggtgtcgtgacttccagctggtatgaaaagtttgatggatgggatcttgaccagttattcaaggagattacgcctattccttgcttttatcaaaatgatgcccatttgctgaccgttggccattgtatcgccaagcagatttctctctcggaaaacatcgtaggtatttataatcccgaaaacagcatgccagggatcacgttgatcttcaatgcttctctgttagaaggccaaaatgcgcttgctggagaagcaaaatacttaccaggctttatcgacaaaggtgctccaaaaagtactcaagaattggtggcccgcttatctgctttagtgcctttttataatgctgcttttgctcctgatcgctttgtttttgccagtacagcagcaatagaagaagacttgctagcggctatcactcacgacccttttattaccaaacagccgaatcatcctgtatatacctttgttcacgacttcgaccaagccatgatcttgggtatgcactggctgcttttccgcaataccccctacgatctatcttgctaaacctttccgttgggcattgggagttgcgccaaaaaaacgaacgagtagatctctcctttttgcaggcgaaaagttacgccaaatcaggggatcaccgttcgttttttgtttacgcaacagtaatttcgatcaaattcccttcaggatcttggatcaccgcttcataataaccatcccctgttgtgcggggaccgctcagcagaggaaagccatctgagacaaaacgttgggcataagcatccacttccgcttggcttttcagagccatcgctaagtgcgtgtaacccagtgtatctgttccaccagggtgaaggtgctgctttgtcgttaattcgatacgactgccagaatcaaaacgcaaaaaataagattgaaacccagtcttggtgttgtgatatttttcagaacgttgggcaccaaaatacgtttcataaaattcggccattttttctagatcacgaacccaaatggcaatgtgttccacaaacattgtatccctcttttcgcttttttatgagaagaatccactttacttgtcctttaatcatgcacatccaaattcttctcttattcattgtatcgaagtttcttctttccagcaattttagtcctatcacagagcaatcctctttcttcttatttcctcatattttaagccattacttgaatggtttttctgaaaccagtcgcaatagttgcagttcctcaaaaatttctctaaagtgaaagaaaataagtcatcgatcaaaaaagattctccagtttgcgaaggaggaatgaaaatgaacatcgcaatcatcggtgctggaccacgaggactgtcactatgtgaaaggttgattgctcaagcaagtatcaatcagcagtctctatctctcacattgattgatccctatccccctggaggcgctatttggcaaacgaatcaaccgcaaagtttgctactcaattctgtgaccagtcaagtcaccctttttactgacgaaacgctagaaactggtggcccgatcaaccccggtcccagtctttacgaatgggcaaaaaaagacggtaggaattttgctaaaaaaaatcagccctcactggtatcagaaattgacaagttggatcctgacggtcattgttctcgcgcattatacgggctgtatcagaaatggttttatcagcaattgattgaaacattgcccccattcatcacattcacgtatttgcaggaaaacgccatcggcctaataccgaaacaaacgcactatttactaaaaacagacaggcactctcttcaatcggaccgagtgattctggcagttgggcatcatcaagtctcgctcactgaagaagaagatcgattaaacgaattcgcccgccggaaaggctttttgtattctccgcctcagaatgcagcggatgtcgattttaataaagttaaaggcggagaacacgtcattctccgaggtctaggattggcgttctttgattatgtcacccgtttgaccactgatcgcggcggtgtctttattggttctgatcgccttcgctacattccttctggcaatgaaccaacaatcattgccggatcaggaagaggtttgccataccacgcacgaggagccaatcagaagcatccaacagaacagattctgcctcgcttcttgacaacggaacgactccgctcttggcaagcgaaagggcaagatcagtccactgagtttttcttttatttgcagaaagaaatggaacttgtttattatcaacgctggctgtctcaagagtctgaagatgatcaagcggcttttactgaacaatttgtccaccaaaatggcgccgccgatgttttgacagacttccaaattcctcaccaaaattggttggactggcgctatatcttcgatccttacaaaagaaaagaaagccaatcggttcgcgactttctgttgacctatcttacttgggatgttacagaagcggccaaaggaaatttaacaagtccgatcagtagtatgtttgaattgttaaaagatttgcgtgatccggttcgctttatgcttgatcagcaattgttttcgccaaaagcattaaaagaaaaattctggcagtctttcgttccattgaacgcctttttatcgattggccccccacttcagcgcattcgtgaattgatcgcactgatcgaagcggatatcgtcacgattcttggtccaaagatgatcgttgaagaaagcggcacctttgtggcttattcagccagctatccccaacaacgatacgccgctaagcaggtattggaagctcggattcaatcgacggatattcgtcgtaccgctaatccattgttaagacaattactagctgatggcattgccagtcctcataagttatacattcctaaggaggctccgttttacacaggtgccattgcgcttgatccggccacaagccagttgcttgatccaaatgatcagattcaagaaggactttactgttttggtatcccaacagaaggcattcactggctaaccgccgccacagcacaaccgggaaccaatgcttttaatttacgacaagcagatcagattgctgcccattgcttgactagttctcttcttggggataggcgctgccttcaataaattgcgattgcaaataaaaaccgatacaataaaagaaaaggctcaaggaggttgaaaaatggcagatgaactacaaaagatcgatgcgttgatcaatgaagtcgagaaagtgattttaggaaaacgtgatgtgatccaattaactgtggcggcattattggcaggtggtcacgttttgtttgaagatattcccggagtagggaaaacgatgctagtcaaatcattggcaaaagccatccaaagcgactataagcgtgttcagtttaccccagatcttttgcccaatgatatcttaggtgtatcgatcttcaattcagaaaaccagcaatttgaatttcgaccgggacctatctttacttctgtgttattagcagatgaaatcaatcgcacaacacctcgtacacaagcagcattattggaagcaatgtctgagaatcacgtgaccatcgataatcaaacctacgcgctaagccctcacttctttgtgttggcgactcaaaacccaatcgaatatgaaggaacctatcctttgccggaagcacaactggatcgttttttgtttcgattacacattggctaccctgcttttcaagatgagcttgctttactgattggacaacgccagcaatccctcaatcaaattcagacaatattgacctcgcaggaagttaccgcattgaaacaaatggtcgatcaagttttcgtggacaatcaagttgctcgctatgcgctgcagctggtccaagctagccgcaaccataatgccattgatttaggcatcagccctcgtggcggcattgcctttttgaaaggggcaaaagcattggctttgaccgaaggaagaacctatgtgacaccgcaagacttgcaacgaattttgccagccgtttttggtcatcgcttattattaaaaggcgggattactgccagccaggaaagtctctctgagatcatgaagcaaatgatccaacgcgttcctgtaccagtgaggcgctgatgatgagcaaacagcggttattgggaaaatatctggtattttttgttacttattttcttttactaagctattgtatcgttttcaataatgaagcaggttggagtctcctcttttttgttactttattggtactagcagacttgttattcattctgccttcccttaataaaatccaagtgactcttgaagaatcgatccaaacacaaataaacaaagaaacgcctttgccgctgcaagttttcaagtatcggccaacgctgttgccaatcccaaagctgtctttgctctttcaaaatcaggaacagacgctcactttttatcggggcgaatccatccgcttagaggtgctgtggcttcctaccgctcgaggagcatataatggactgccattgaccctcacaagtcaggaactttggggattcttcagaaaaaggcggcaaatgaaaatccaacaagaaatcctcattttgccagaatatcgacccgaggtcctatccttgatgacactttttgaaaaaaagccgcgaaaatatacttacggggaatcaaatttcaccattcgaaactaccgtaactatcagcaaggggattcattaaagcatattgactggaagctctccagtaaacagcaagaactgatttatcgagaacacgaaacggaacaacaacaggagttgactttgttgttttggggtgaatctcaccctgcttttgaagacacattggcgatcttcttttcgctccaaaatctcttgcttaaaaagatgccttttcagcaactattgatcggcgaggacctggattctccttatcaaatccatgctggagctttcgcagcgattcagccatttatcacagtcccagaaccattgcccaaaatctcagggcgtcaggtgattatcatcacaccggctgtctcgcaatccttagaagactatctggaatccttgacgccaagcaacatgctgcaagtttatacgtatcatgacctgatccaacgactgtcgaacaaagaggtgtctgaatgaatcctttgatcaaaaaagccataatcggagctctgacttacattgcgatcattttgacggtgctgccgtttttagcagtctaccacttggggcaccaaactacgttgcttctgtacgcctttctgatttgctttgtgagtattttaagtcctcgtcttcgctacagtctgcctttttacatcgtaggttggtttgtcactctttaccgcttttttccttatggtgaaggattttccttcacttggttccaaagatatttttatgatttgcaaacagctctcagcgagattctggctggcaaagtcggttatatcactgaacttgttgcagtgaccattatcgtcaccggcattcttctgtttgctgtgttctcgatctacatccagcatttttatattgtctacggtgcaatgtgtctctatctgctgactgtcgtgatttttaatgatttcaatctaacgtggcatttgttgggggtgtgtttttgcggagttctttgcagcctgatcaaaacccaacagctgaaaacagtacgagaatggtcgttctggctggggctcaccctgctatgttcgttgctgttggttggagcaacactgctgccaagaaccgcgattcgcgatcgcttggtagcagctaccactggtatacgcacacaagcgaatcaacgcggcttttatcagtttatcgaagaacatggtgcacctagcgggtcccgtacaggctttagcgaaaatgatcggcaattaggcggtcccttattagacgatgataccgtgttatttacagcccaacaagatacccgccattattggcgagtagaaagcaaagatttttattctggcaagggttggatcaacacgatacgggaagaagatctgcgaacagtgcctgattccctgcggattgcagatgataattatcaacaagattatcttaaagaagaaacagtccagctttatttgcagaatcagggagattatttgccattaccttatggaagcaatcacctcactattgaagaaggagcctctggttttattgtggatgatgcggttcaacgagtcgatctaatggagccgcaacaacagattgaagtttcactggcttggcagccagcggactatgccgctgaaacattgcaatccttgccgctgcaacagccagatactcctgttgactatacacaattacctgagaaccttcctgcacggattcggcagcttgcgcgctcaatcacagaagatcaaagtaccatcttcgaacaagtcacagccattgaaaatcacttgaaaaattcaattgaattccgttattcaaaaacggatgccgtctatccagcagaagaacaagactatgtcgatcaatttttgtttgaatcaaaagttggctattgtgataatttctcgactgcgatggtggtattattacgaacgctcgatattccggcgcgctgggtcaagggtttttcgccaggagatgctcaaactgaaaatggcctgacaacatttaccgtgagaaaccgcaacgcgcattcgtgggcggaagtctattttgccggttttggctgggtaccgtttgagccgacgccgaactttcaaaatcctgatcgtcccgaattgcaaacaacaactgtctcttctgaagtattacctgaaacgagcagttctagtcgcgagtcttctaccagcagcagtagtgagatcagcagttccacaacaacgacggcaactgttgcgccagcagaagaacaccttttctcacctgaaacatggcaatggatccgttcttttctgcaaggtatcgcatgcttggttttcttgggattactgtatcttttgcgccgctactttttccgaattcgcatctggttgattgctcgctttcgttccgaaccattaccaaccgcctatcctgtcttgatgaaacaagcagcaaaagttcttttccatgctgattcggaacctcttagtgagtacgccagccgattggaagctgtttatcctattttccacgggagttttatccaactgacggcaacctatgaagattatctttacggtgggaaaccaatagacggccaacaacagctgattcttcatgtcgcccagcaaatcagtcaattaaagaaaatcaatcaagtccattaaatgaaagcaagaaaaagaaccgaagacgcagtgctgcatgctgcgccttcggttcttattttgttcatctgattagcgaaaacactctcgcaagtatcatgagttcgtgttgttccctcgagattgtaccgctaaaataatcagttttgtgatttccatcatcaagacagcaccagctgccatagctatgcttaacccaacatggttcattgtaaaggtttctggaatcgcaaagacttcccgaattccaggtagcaatgtcacactataaagcagaccacaaaccacgatcgccagccaaaccattttattcgcaaacaatccagcttgccaagcagtctctgtattggaacgagcaggcaatgtttgtaatgtacggctccagatcaaagttgagaatgccattgcaacacctaactccggcgattgattcatcccgatccattgcgctataatcaccactgccgcaatcaagatcccacgataagtaactgagatcagcgttttaccagaaaagatgccagcatcaggatttctaggttctctttgcatgatagttggttccgctttttccatccctaaagcgatagcaggaagcgaatcattcactaagttgataaacagcaattgcaaggctgtaaatggattgtcccagcccattactaaagcaaacacaatggcgataatcgcgccgaggttaccagcaaaaagataagaaatcgcctttttgatattatcaaacacattgcggccaacttctaccgctcgaataattgaagcaaagttgtcatctgtcaagaccattgctgctgcatcttttgcaacgtccgttccggtccccatcgcaatcccgatatccgcttgcttcaatgctggtgcatcatttacgccatcaccggtcatagcagagattttccctttaccttgccatgctcgcacaatgcggattttattctcaggagagacgcgcgcgtagacagtgattttctccaattgattcgtcagttcttcttccgacagtgcatcaagctctgtaccggtcaatgctaagtcaccttcttgcgcaatcccgatctcctgagcaatggccacagccgtcgttttgtggtcaccagtgatcatcactgttttgatgccagccgatttcgcgtctgccacggcttgcttgacttccttccgagggggatcaatcatcgccatcaaaccaacaaagatcaactcttcttcgagacctaaatgcagttcttcgtcttcagacactgtcagcggacgataagcaaaagccaaaacccgcagcgcgcgtttagagaattcttcattttgatgctgcaactgatgtttgatttcctcagtcagtggaacgatttcgtcattgataagaacctttgtacttcttccgatcacaatatccggtcccccttttgtcaaaaggagttgttccgaatcaatggtatgcaatgtggacatcaatttccgatcggaatcaaaaggcaattcttgtaatcgcggatattgttgacgaatctcacgatacggttgattcaatttttctgtataatcaagaaaggcaatctctgtgggatctcctagtttagctccttcgggactgattgccgcatcatttgcaagcacactgatctcgatcaagcgacgttcaggcaatgtccattcagcaggattctcagaaaattcacccgtctgtccatttggcaaataaaaatcaacgaccgtcattttattttgggtcaatgttcctgttttatctgtacaaacaatactagtagaacctagtgtttcaactgccggcaacttacgaatgatcgcatgttgacgagccatttgtttggtaccgatcgataaaacaatcgtaacgatcgattggagtgcttcaggaatagcagccaccgcaacagcgactgcaaacataaaagcgttgactagatcggcggtcatatcgccagacccatcacctaaaaatagccgagcaacttggacacctaaaataatcaaggaaagaacgaggatcgccaagctcaattttttgctgaagcgatccagcccgcgttgtaatggcgtcttgtgttccactgtgttttctaataaaccagcgacttgcccgatttctgtcacatttcctgtggcagtcacaatgaaacggccacggccgtaagtcacgatcgttccactaaagaccatgttatcgcggtctccaataggcgctgtgcggtcaataaccccaagttctttttcagcaggtgtcgattcgccggtcagcattccttcatcgactttcaatgccccttcttcaatcagacggccatcagcaggtacatagtcccctgcttctagaataacgatatcacccactaccaattcttttgccggtaccgtttgttcctttccatctcggataacatttgcattgggtgccgagaggcttttcaatgcatctaacgatccttctgcttttttcgtttggatgacactaacaaccgaattcagtagcaaaacagcaaaaatgacaatcgattcaacatgggcgcccatgatcatctgaacgatagccacgatcagcaaaacgatcaccatcgcatctttgaaggtttctaaaaagagtatcaaacttgattttttgggagcttctttcagctgattcaagccattttctaagcgctttgccgcttcttgctgggacaatccagatggactactgtttacctcgttcataacctctgtgatttctttttgatacatttcttttgccaatgatttctctccttcatagttgctatcccttgcatgagtccttttttagaaaaaaagagacctaagacaagtggatgcttgtcttaggtctcaccatttcatataataccagaaaactgtcgccagtttacttactgttgatattatcgcagccgaagccactggttactcccctaagggtttatcagaatgtagaatcatcataacgaaattttttgaagatagcaacctttatgcacaaatttgtcttttctcagatatatttttttgaaaaaagcttcttttttctgttacactaatctacagcgtaacaagcgtgacagaggaggaacaataatggaaaccattgatttttttacaagtcacacatcggttagagacttccaaaaaaagtctttatcagcagaaatgaagcaacaacttgtcaaagtagcacaaagcggttcaagttcaaatttcgttcaagcctattcaatcatcgagatcaaagatcctaaaagattggcagaaatcgagaaaatcgccggtgctccccactatatcacacagacgggtgtcttttatctgttcgtagcagatttatataaacaccatcaattgttgcagcaagcaaatttgcctagtgctggactatcgaatatggaggccctcttggtttcggttgtagatgccaccatcgccgctcaaaatatggcagcctttgcagaaacccaaggtctgggaatctgttacattggcggaatccggaatgacttgttccgtatcgctgaactcacggagctgcccccgtatacactgccattgtttgggttgactatcggttatcccgcaacgaaaaatgagccgaaagttcgcttaccgcaatccgctgtgttaagcgtcgaccactatcagccactgaccgaagacctcgttgctcgctacaatgaaactaccgcggactactatgcccatcggagaagcaatcaacaaaaaacggattggcaaaccaaaatgactggctttttccaagaacctcgccgtccggacgtagaaaaatttttgaaaatgcaaggctttttgacacagtaagtacgaaaacaagcagctgctccttgttaccggtcgctagactatctccatcaaaaaaacacctcatgaagaagttcttcatgaggtgtttcgagttgttttattttgccaaacggtagatggcatctgcataaatcactgccgcgttgaatagatcatccaagctcataaattcgtttgcttggtgcatcgtatctgtgtagcctgggaacatcgccccatatgcgacaccacgttttaataaacggccataagtgccaccgccaatgatttgttcatagcctttttggccagtatgttcttcataaacttcaagcaatgttttcaccaatggatcatcaattggcacatagtgaggctccatgttgcgctcgttccgagtcactgttgcgccttccatgccaacggttttttcaatgccgatttccagaccttctgcagttaccccttgagggtaacggaaattcaaggcaataaagttgtctgcttgaacacctgattgattagctttaaaagcaaacaaaccagcattcatggttagtttacccattttttcatcttcatgcgccacgcctaatttttcaccataaaaatcttcatggacataagctgccgccgtatggataaattgtcttgcgccgccgccaaaggcaaagttgtctaaaaagactgccaagaaagttcccgcattgatcccagactgaggacttgcaccatgggcgcctttaccgactagttcaatggtaacttcttcattttctgtttcgatggtgccagtcactggttgaccttcgacataatcaaaaaaagctttttccatttctaatgcagcttctgtagacggggcagtcaattttgcaaccgcagttcctggtaccatgttttcccgcaaaccagcagtgaattgttgcagttgataagcaccttcgttatttccttggaaatgaagccctaatgttacattccctttttcgccattgatgattgggaattccgcatcgggagagaaaccaaaatcaggtttttcttcatgctcgaaatagtaatccatatcaccccagccgctttcttcatcagatcctacgacaaagcggatttttttagataatggcaagcctaactctttaatgatcttcattccgtaataagcagccattgaaggacctttatcatcggaagatccgcgagcataaattttattgtctttgatcacaggatcgtagggatctgtcgcccaaccgtcaccagcagggacaacatccatgtggccgaagatccctaatgtttcgtctccttcaccaaattcgatatgtccagcatagttatcgacatttttcacagcgaaaccatcacgttccccataagccaacatgtgcagcaaggcatcacgaggtccaggtccaaacggagcatctgccgttaccttgtcatcttctcgttcactttttactttcaaaagatcaatcaagtcatttagcaaatcgtctttacgcgcttcgacttcttttttccaatcgattgtcatacgattccctccaattcttttctcgccttttatgataacactcttagctgaaaaaaggaaaaaaaattgtgtattttcagacgatatctttcataaaacgagtataataaaagcaataggtttattctagaaaatgagcccagtgaaagaagcagaaaaggagtcattgtatgaagcaactggagcaaactattttagcagcagtgattcgcaaacgccccgtcgaaagtcacaaagggacctttggccgtgccgtagtgattggcggtaaccagcagtacggaggcgcaatcttgatggcggcacaagccagtgtttatggcggaactggactaaccacggtgatctccgatcctgtcaatcgtacggcgctacatgcgcgactgccagaagcgatgttcgtctcttgggaccagactgagcttatcagcacggtcactgaatctgcggatgtcctattgattggcccaggcatgggggaaggcaaaaccagtttcaatctgttgcaaacagtcgtcgctgaacaaaaaagccatcaatggctagttgttgatgggtcagcgatcaatttagctgcgaaatacccattgacttttccttaccccagtcacgtcgtatttacccctcatcaaatggagtggcaacgattaagcggcattgagatcagtgagcaaacaccggagaaaaacacagccttccaaaaaaaattagccagtatcgtggtcttaaaaagccatcgcacccagatttatggcacagaaatcgtcgaaaacccattaggaacgccagctatggccactggcggcaccggggataccttagccgggatcattaccagttttttggcacaatttgatcgaaccgaagaaacggtccacgcagcggtttatctccacagtttgattggcgaacatttagctaccgagaactatgttgtcttgccgacacagatcagtgaagcattgcctaaatttatgaaggaccattcgttgggctgattggcgtaacgaatggtccttttttcttagtgtacttcagaggggtgatatacgatcctgacttcatagggtgccaacgtgattgctcctactagatgttcattggtttccagatcggttactggctgcttcaatactagttgctgttcttcctctgaaaaattcataataaatgaatagtctcgttgcgtcccaactcgcgtttgaatcgacacctcaggaagtgcttcagcaatcgctgttcttctcaatcccaacttttcaatcaacttttgataaaaagcagctaagaaatcactgttcgttcgggcagccaaataatacgaagcccctgcaccgaatggcttcttcgtaaccgcaggcgtgccttgatagaaatctgtctgataatggcttaaaacttctgcatccaacacgtcaatgattgctgaatagtctttggtgacaaatcgctgatcttgaaaatcaatctgattgtgttcgtcttctaaaagtgtttcaagctctaatacctcaatgccaaagagcgcctttaatggttgaggcaatccgccaatataaagcaaatctgtttcattgaccattcctgtgaaatagctggatactagtattccacccttttcaacatagctcgttaattttagcatcgttttttctgtcatcatatatagcattggcgcaatgactaattgataatcagaaaaatcctgctcaggagtcagaatatcaaccggaatgtcttgttcccagaaaacctgataatgctcttgcaacgtttggggataacgtctcgtaggacggccgaatcctcccccgcgcttcaacgcccaattgctttcccagtcaaagagaatcgccacttctttcttgcgagtggttcctttgatttcactgattttttcgagacgagcgccatattcagcaacttctttaaacactcgattgtttgtggaatcatcatgactgacaacggcgccatgaaatttctccgaattgccacgagattggcgccactggaaatacaaggtactatctgacccatgagctaactgctgcatactacttaaaatatggaccccggggcgcttcgatttgtcgtattgttgccaattgacataacttggggtacattccataactaaaaagggttgtttcttcaaagaccaatactgatcatggacataggcagacttcatagcggttgtagcgattgcttcaaagcgattgttccaatcgggataactatcccaactaaccacatccacatactgagaaaacttgccatagtcgattccttccagaggaatgaaatcctgtgtggcatgaccttccgccataaaattcgtcgttactgggatatcaggggttcgttcccgaatagggacaatctcattcaaataaaaatcaatggtctgatcagtgacgaatcgtttccaatccagatccatcccatgaactttatgttctcctaaaggtgatggtggcaagacttgttcccaatcggaatagcgattgccccagaaactcatccaccacgcatgattcaatgcttctaggtttttgtactttttctttaaccagtcacgccaattttcttggcagtattcgcaaaaacattcacccgaatactcattggacatgtgccacatggctagtgccggatggtcgccatagcgttcagctaattttgtgttgatctgccgcactttttcgcgataaattggtgaagaatagcaatgattatggcgaaagccatgggtatgtttttgtccatacgcattggtgcgattgacttccggatatttctgactcaaccactggggacgaccaccgctgggggtagccaaaatgacattgccccccatagcatggatcgcatcaaactgttcatcaagccagtcaaactgatagaccccttctgttggctccaaagcgctccaagcaaacatcccaagtgtgaccgtattgacgtgggctttttgcatatacgccaaatccttctttaggatttccggataatcaagccactgatcgggattatagtccccaccatgcaggaaccgctgatcaaagaaataattcgtcatctttttactcctttttgattgctttgatttgataaacaaatgactggaaatctcctgttacttgcgccgtttggtgattgacagcattgaataagtacggtttgcgcagtccaatttgcttcagaaccttgccagacaactgctcattctccagcagatagcttcgatccagatcaatgaacggtaccggtataaaagcttccgctgcaggatttgcttcagcaagaatccgaaaataggcaatcagtgcttcctcttgatgagagactccccatacaacttcatttttttggctcaaatcggtcatccgatagaaggcgccataagtcagaagttgtcgatgagctttatagaaaatgatttgttctttgattgcttgtttttcagctgctgataaactgaaaagatccagctcgtagcctaatgggccaaacatagccaccgattgccgaaatgccagtgacgtattgcgccccacttgatgattgggacaagcggagacatgattgctgaatgaagacatcggatagccaagtaatgtgccggtttgaatttgtagtcgttccacggcatcgctgtcgtcactcggccaaatctgaggactgtaaaacaagatccctaaatcataacgaccgccgccgccagcacagccttcgatcaaaatctccggaaattctgttaatattttctgataaagggcatagacccctaaaatatagcgatgaaagaattctgtttggggaatcccttcatctgctaaataaggtgaataagcttctgtgatattccgattcatgtcccacttgatataatcaagatccgtttcgacgatgacttttttgatcgcagcaaagattgcctccacgactgccggattggcaaaatctaagacatactggccgcgccccacagagatgcgttcataaggatgtcggaccacccaatcgggatgtttttgataaaactggctgtcaggagagaccatttccggttcaaaccaaacgcctaactgcaaccctagatcgtggatttgttttgcaaaatgaccgatgccattaggaaatttcgctggatctggcacccaatcccctaaagaactgcgatcgttgtctcttttaccaaaccagccatcatctaagacgaagcattccattcctaatgcctgactttctgctgctaatgctactaatttctcttggtcaaaatcaaaataagttgcttcccaattattgaagacaatcggccgcggccgtttttgccaataaggggcaatcacgtgcttttcaataaacgcagcagactcttgccctaacccattcaacccttcatcggtaaatgtcaatatacattctggggcttcaaagactgcatcttgctgcaatgtccaagaaaactgttcgggatgaatccccagcatcaagcgcacattgtcccactcatccatctcgacttgagcgagaaaattccctgaataaatcagatttgctccatagacacgtccctgatcattggtggcattggcagccttcagtgccacgaagggattgtgctgatgcccagaggccccttttaaagaccccactcgaaaggttccttgcgtcaatggtgtggctttgatttggcgttcctttagccaagcaccagaaagatgaacaaattcaaattgctgatttcttaattccagtaccccgctcatcaacgaagaaagttgttttttctcagcgccaagattggtgatccgctgattgcgcgcaatcgtgcctaaaccagcaaaaatagtgtaggtgatttccattttcaattgccgctgctcatcgatcaacattattcgcaggctttggctttctgttttttcggcaaaactcgccggtttggccagctctcgttcctttcctgcgaaagtttcgacttctgcgactttaaaatccacatacaaaggcacgtcttctgcaaaaatagtaacggctccttctcgaaagtcagaagaaccataggttggcaactcttgaaagcgatctgctaacgtaaacaggccatcattttcaaaaaatttgaccgtgccggcagatttattttcttttttggttaaatagtccatgtcattggcactcaaatgccccaaagatggaccaaagtacagatgacctaattgtcgatttggtaaaacatgcatcacataactaatcttttcattgtataaatgaaaaatcgtatcggttattatctcaatcatttttttcctctaatttcaactttattctcgtctatttcattatatttctggcatgcagtttccaaatactgcatgcgttttttgacccctttgttaaaaaagaacttatagaataatgctgccagcatgaaactatacgtattgcgggaacgatcaaaagaattctgttccgaatacgtaacctcaatcttttctgctcccctaggaacaaagcgatacctttgacagatttttccttgttcatagcctgttatcaaagcaacctcatcttgcgcgatttttttgactttcagcaccgctggcaccagcgtggccgctgattttgtgcgaatcatcaaatcaatttgactgttctcgccgaaaggttcttctgctccttttgagcgaaagaatgccgcttgttgtgcgatcatcacttgatagaatcgttccggcgttgtacgcatctgataagtataggtcaatgtatctgttcacatcttcgatcctccattttttcagttgccatgctgacagaacagaatactaagcttagctttctttgattctttcgtcgatggcagggccagtttgtgcgagcgcttctttggctagctcttctttttcttctttcaaatagccacgatccatcacgattaggaatggcacccaaatcaatgtcatcacagcaacagttaccaattgtagaatggcacctgctacagagccagttcccagccagccagataagaagaccggtgtcgtccagactaccgttgctccgattgggcgaggcacaagaccagcagcgattgcaaaataagaaatcgtcgtactagcaagcggggccaaaatccacggaacaaaagcaatcgggttcaatacgatcggcaacccgaatgtcattggctctgacacattgaaaacagatggtgcaatgactgtcttcatcagcttcttcatccgaatcgaacgagcaataaaaaatgccatcgtaatcgagatccctaattgcattccttggtttacaaaaacgcccatgaaggttgtattgatgatatgaggcagttgttctgcacctgctttataggcttcgtagttttcaatcgccaatgcattcatgatcggatcaatcacggcgttaacaaccagtgtgccatggatcccaaaccaccagaagaattgggtgaataaaacggcaatcaagactgcaggcaacgtgccccccaagcccattaatggtttctgtaagatttcgtagacaaagtcgaccgcattgccccatgacgtgaatgtaaacaagtaacggatcaaattaaataaaaacaatggcgcagcacctggaatgatagcaaggaaagactcagcgatcatcggcggaaccgattcaggcattttgatcgttaacccagaagcactgatcttgcaataaatttgtgtagcgataatcgctgtgatgatcccaacgaacatcccttccgcacctaattttgaaaggggaatcactgttcccaggtcatcggaagaaccgtagggcaaaagcattaagaaagaggacaatgagattgctccggcaaaaagttttggctggccatattttcctgccaattgatagccgatcccgaaaacaacaaaaatcgctgtgatactcatggttgcgttcccgataggaccaaagaaatcattcaaaaaggtcatcagtcctgcgggcagtttctcagataagccaaaggtagcgggtaaattttgaataatgatcatgattgaagcaaacattgtcgcgggaaaagcaaccataaagccatcacgcagactcaataaatacttattattggcaatgatttgggcaaaaggaaccatcttctctgctaatttatcaataaatttcataactaatctcctttaatttgtctgtaaacgtttactacaatcagtataattgtttagttaatgtttacacaactctaaaataaaaaaaagatcatttttcatgatctttttttatcggcaatcgattctcttaatatcaattcacttttacaaatcactcggactggcattgttcgaacgcccaataatttgtttttcgccagctctacactcatttgacccatttcttccgctttcattttgactgaagaaagcgctggtgtcataaactgggccatttgaatatcatcaaaactaaccactgatatatcttctgggatcttcaatccgtgttcatttaatgctttatagacccccactgccatgggatcactagcaacgatgatggctgtcggccgtggggtcatctcggcgatttttctgccaaaagctaatccagtctctggagaccattttccttgaaaaacatgactgtattcttccagcttgttcatcagcatccaatttttgtaattctctgcacgaatttcttgttcatcataaacgacttctcctgtgatcgttactcgactggaaacaccaccaataaatgctatgttctcatgtccttttgcttttaagatatccaaaatttgatgggtctttcgagcaaaatcagtttgtatgcaatcataggcgtcgttttcactataattatctaccaaaataatatgttgattgtaccggctgatttcttgcaatgcctcttgcgtcatttccccaatgatgatgacagcaccatactttgccagttgagtcagatctttgtcttggtctcgcatcgagaagacacgaaccgtttttaaacgccatttggctgcctctttctctattccgttacgaatcatcataaaataaggatcattacgctccgattcactgttatgccgtgtaatgattgctatcgtatttttatcgccagcttctcgcgaactcgaaaagctcttgtcttttgaataattcagctggttggcgatctcgatcacccgtttgcgggtattttcgttgatactaaatgtttcatcattgtttaagattcgcgacacacttgcgacggaaacccctgccaattttgcaatatccctcatacttgccattctgccaccccgttgtttactgtttactaaatctctttttaagaatagagagaaacagcgattttgtcaatccctacttgttacgcaagaaaacaggttaggttatcgcgtgcagaaaaatagttgcttcgtgtatgataaaagtagaaataggagggattcagatgaatatcacaacaacacttatgcagcaattggaaaaagacgaaggggaaatgattgcgattcggcggcacttacatcaacacccagagctttcatttcaggaaaaagcaaccgccgcttatatcaaagcctactatgaaaaactagactgccaaatcacagaatgtggcgacggctatggcctgatcgttgatatcatcggtgagcaatgtggaaaacagctggctttacgggccgactttgatgctctggctgtagaagaagacaatcagctgccttttcgatctcaggttcctggtgtgatgcatgcttgtggtcatgatgggcatacggcctatttaatggttttggctaagaatttgattaccttaaaagaccagttaaaaggaagcatccgcatcatccaccaaccagctgaagaagtatctcctggcggtgccaaaggcatgattgccgacggttgtttaacagatattgatcatgtacttggcgtccatgtgatgtcttcaatggaaacaggcaagattggctaccactctggcgaaacccaaactggacgggcaaatttcactttgaccattcgtggcaaaggtggtcatgcttccatgccgcaactagcaaatgatgccatcgtagcaggcagttatttcgttactcaactacagacgatcgtttctcgtcggatcgatccttttgacacagcaagtctaacgattggttcttttgacgggagtggttcctttaatgcaatcaaagagactgtgaccctaaagggagatgttcgtgtgatgaaagaaaccacacgtcaaacgattcaccaacagatccagcgaatggcagagggtctagcacaaacttttgcggttgaaaccagtcttgaatatgatgacaattatccggttctttataatgatccagcttttacaatacaagtgattgattccctcaaagaagctcacttacctgaagtgaaggagatctttgattgcggtcctcaagatccctctgaagacttcgcctactatgcacaagaacgacctagtcttttcttttatatcggttgtatgacagaagatcatctcaatcatcctcaccacagtcctgatttcatgatgaatgaagactgtctcttgattgcagccaaagcggtcggtaccgctacaattgcttatttaatggattagctcctaatcaatgcagttaaaaagagtagtcataagttcccaaaacggcggtccccatcatgcagggtatcgtatcgttttgtctcaacttatgtctactctttttaatgagagatctggattgaagtaatcgaagcaggacagataattaactgaatcaaacaacaaccactcattcccaccaaaaataagtacgccggaccgaagaagccaaaaaacaacaatagcgtaatcgtccaaaaaagatggagcaacactcgtttaggtgagcgaccggcttgataaaaagcataaaagaagctgacttgctgcttcttttcgcccattaaaagcgtctgatagaaaaaaatcaagctacagatcatgaagatcacgatcagcatcgtggccatgacttgaaaaagcggttgtggaaatcgactaagaatggaatgatcaatcaaaagaaaaagactataaaagctgaatacaatatctttctttttattcagttgccacagctcagaaaatttcgtaaagaaaatcgtcgtcgttttctcttgttctgccctctcttgagtgtctttgatctgcttaatcgccgcaatcatacttcttgtcgctgttgccactgtaaaaaaaggcaatgagcaaaccaaccacaaaaattgtagaagaatcaatttgggcatccaattgatccaagtgatcagaccattgaataaacgctgcggctctatctttctcatcctttggttcctcccgtcagatccattccctcaataaagtagcgttgtgcaaaaaagaataataggatcgttggtaataagaccagtgttgcacccgccatcaaatagttccactgtgtcgttgattgattttggaaaacttgcaaaccgatttggagtgtatatttttcttgattttgaatatacagcaatggtcctaagaagtcattccaagcaccattgaatgaattgatggcaatcgtgatcagtgcaggtttggttaaaggaatcatcagatggctccagatatatagatgattggcgccatccatttttgccgcttcaatcagttcattattgatcgataagtaaaattgccgcatcagaaagatattgaaggcattcccaaaaaatgagggaatgatcagcggcagatacgtccctacccagccgattttagaaaacagcacgtattgtggaatcatcgtcacaaatcctggaatcatcattgttgaaaggaccagagaaaaaatcaggtttttccctggaaaatccaacttggcaaatccataagcgataaatgagtttgaaagcacgttgccgaacacaactaacaccgtgataaacaaggtgttctttgcatattgccaaaaaggaaacgcattgatcgtatcaagataatttgagaaattgatttcttctggaaaaaacgttggtggataacggacgatctcttccattggctttaatgaggtgaataccatccacagcaacggaatgatcagaacgatgccaatcacagtcatcactaaataactcgttaactttttgatccgctgctgttgagaattgctctttattttgtacatctgcatacagtcagccctcctgagatagtgtactttgttgaagccatcagttttgtcctcctgcatagtggacccaacgaggagctaatttcagattgataaatgttaaaactaatacgattaagaaaaggatcatcgacatcgccattgcataccccatatcaaaagctacaaacgctttgttccacatatggagattatagaacaagagcgaattggcaggtccaccagtgccgtttttcgtcataacataggcttcttggaagatttggaaagaaccgattgtcgacgtaatgacatcataaaaaataattggtgtaatcaatggaatcgtaatatgtttaaacttagcccacataccagcaccatcgatctctgctgattcataaagcgttccggggatgttctgcaatgtcgccaagtacagcagcatcgcccccccagagctccaaattttcattaggatcaatgccggtttggtccattcaggatcaaacagccaggccggacctttgatgttgaaccagcttaaaaaagtattaatcaaaccagcggaaggcgacagcagctgcatccataacacatatactgccacaccggataaaatcgctggcaaataaaaagtcgtccgaaaaaagctgattcctctaatcttttgattcaataatgtagctagaaagacactgaataaggtcgtcagtgggacattaaagagtacaaaataaattgtattataaagtgatttccaaaaaagtgcatcttgcgtaaacattcgtttgaagtttccaaaaccaataaaattcatttttgacgttagattgtaatccgtaaagctgccgataaacgagaataacatagggcccagcatgaacaccatgaaaccaatcaaaaacggcgctacaaacaaatatccccagagggcatcttgtcttttgcttctcgatcgtttctttttcataattcccctcctttagtaaagtgttttctgccatcttttttcagcaaaatagcaaggatgcaatgagaacagtaacgatagaaaagggaatgcggctagccacaactccctatctcaatctattatttattttgttctacaagatcttccactgctttttgagcatctgctaatccttctgctggttttttattccctagcagaatttgatcaatttgttcattgactaaactgctgaaatctggtgcatccaatggtaccggagtgattactgtattagcaaaattctcatctgccatttgatagatcatttgacctttttcatctaaatgatcatttttgacaagattttcatttgctgttcggttagccataatatcaaagctcttttcaccaaatttttcttgaacttctggggttgaaagatactcgataaacttgtaggacgcttcgggatttttggctccttgaggaacttctaagacaaagccgccaccccatgaccagtgaccagaacctttttctttttctggaatctggatgacgccaaaatcaaagtcatctggcgcattttccatcaagctagagtaataattgatattctgtgcccgcatggccaccaaaccagaaataaatggatctgctacaccggagccaaactcagcttctaaacgattgatcgtatcttgcccataataatcttgccaatcaagaatccaatccagagcctccactttattttctgtgtcaatcgaaaccttttcatctttgtcaaaccaactaacaccgttatcagcgttcaatgcccaaacatccgcgccaaggttccacaaaggatagaatccgatacgctcaaaatcatcgccttttttgacatctaatttgtgtgcaacagtttcaagttcgtcccatgtttggggtaactgatcttcactgatccctgcttctttgaaaatttgtttgttataaaaaatcacttgggtatcggtattgaaaggaattgcataagggtctccttcatattctaccgtatcccataattgaggataaaattcatcagacatgccatctttaacgtactcgctcaagttcgttgcttgctgtgcttctgcacgctgcgcgactgaattgatgtcttgaacaataacatccggtggatttcctgcagtgattgccgagagagacttcgtccaaatatctccccaaggctggtaactatatttcacttcgatttcatcttgtgactgattaaaatcgtcaatgatctcttcgatgacttcttggcgagcccccgatccccaaaaagaccaaaaatctaatgttattttcccatcacttgtctgttttcccgatgcgtcagtatttttgtcttccgaattactgccgcaagccgctgtcaccaatgcggtcgaaaacagcaacagccctattgatagtgcctttttcatcttttatccctgctttcatttttatcattattttataatgttgtaattttaaaatatcatgactcttagtaatgagcaaacaataagcattgtttttttatcaaaaaaaataacgaatttcatagccggagattttttgtagcgttttctttgaaatcttatttattttcaggcatgatagttttagaggatttttcttaagctattgttctcttttttcatttttttatcacttaagaaagaacaatgaaaataaaactacgttttatgaaaaaaagaaagaaggaatcgtcaatgttagttgttattgatatgcagaatcagattcgtgatgaaaatagtcaatcatttatttctgacagcctgctttgatcacgcgaatcgcaaaacggcttcaacaagctcgtgcagaaggtgaatatatcctttttacaagagatatcccgattgattgtaaagatactcctgatgaagaacaagaagcgttacagatcgttcctgaactgcaaccgttaccgaatgaaaaagtaataaaaaaatattactttagtatcccacctgaagttctcttggaaatcaaggagcaacttttcaatgataaaaatgaacaaaaacatatcgaagtgaccggagtagaaaccaacatctgcgtgttgtctaatacgatcgagattcagagtgcttttccagaagccgattttctcattaatcaacagctagtttcaggtagaaaccatgagtcttctggattgaaaatcttacaagacttcaatgtcgaagtggttgatcggacagataactaaaaaagaaacgccaaccacaggcgtttcttttttagttattatgcagtaattcttgcggtatctcgatgcggacatcatttgttgtctgacatgcaggacagacaaaggtgccttcgatcgcatcttttactttaccataatcataatgaatagcgatttcatctgagtgtaactcgttttcttctagaggcggaactgttttcagcttcccatctacatcttcttgcagatgaacaatcaatttgccatcataattttccttgcaattcacacaagatgcttttccacgaatcgtaatatccatgtttttctcctcttttctacttttatgtgagtcctcattggggatacgcttcgatggatgagcccatcgatcctgttttcgatccacctttatagtgtcacgcttgtttagttaaatcaactattctgttttcaactgtcttgccgatcgcaaaaaattcggctggtaaaccttgagcgtttcttttgtcaaaagcattttttcccggcacaattattaagaacacgaattttttgtcatcccaaaagaagaaatggcagtcaatcacacgaccaggaacctttcccgtcacatctcataaaaggaggaacaagtatgcgtgcagtaacatggcaaggaaaagaaaaaatggaagttcgaaatgtgagtgatccgacgatcattgaaccaacagatgcgattattcgagttacagcaacagcgatctgcggctctgatcttcatttgtatcatcacggtggtgcagtactagaagaagggtacgttgttggtcatgaaccaatggggatcgttgaagaagtcggcagtcaagttcaaaaattgaagaaaggggaccgtgttgtcatcccttttaatattggctgtggacattgtcatttttgtcaaaatgagatggagagccaatgtgataactcttctgatcaactttatggtggcctctttggctttggtaagctgaatggcaatcattggggtggacaagcagaattcttacgggttccctttgctgatttcacttcgtttgtcgttccagataccgcgatcccggatgaaaaagtgctttttctatcagacattttgccaactgcctactggagtgtccaaaatgcgggtgtcaaacaaggcgataccgtcattattcttggctcaggacctgtaggactttttgcccaaaagttcgccgttatggctggtgcgaaacgagtgattgcggtcgatccagttgcccatcgactggaaaaggcgcaaagctacaatcaggtagagaccttccaattggatgaccttgcgacaagcgctgatgatttgtatgaattaacaaaaggcggcgccgatgtcatcatcgattgcgtcggtatggatggtttagaacccgtcaaagaaaaagccaaaaatttggtcagcttgcaaagtggtacgatttcaccgatccaaatggcggcgaaagcggtcaaaaaatttggtaccgtgcaaattactggtgtctatatgactccagcatcgtcctaccctttacaagagtttttcatgcgcaatgtggcagtgaaacatggacaagcacccgttatccacttaatgccaaaaatttatgaaatgatccaaaaagaggagatcgacccaacaccgatcatcactcataccatgcctttagaagaagccgctgcggcttatgacatttttgacaaaaaagaagataacaacatcaaagtggtattaaagccaaattaacgcaaagaaaggatgatcgccctcagtgccaaaaatcaaacgaaatgaacatcagatcgaacttggtaaagacgaagacgtcattattaaaggacgccgttttcatgtctatttcaaaaaccggtatctgctgatttccctaacgaatgatattttgactggtttattttatattttcggaagtatcgtgtccttgacagatctgcctgcgatctatggaactatcgcctatctgataggagcaatcttcttaacgatccgaccattgttgaagatcgtccgtcatgtatttatttacaatgaacggaaacaaaatggagagaaagaaaagaatatcgaagtatccgatgatggtgaataaacagtgacgattttcttcaagcagtatttttcccaaaacaaaacacatgctatatactataaatatgcacaaagaaaggagaattctaaaatgaaagtattagacagtatagctttagcgctacttatcgttggcggcctaaactggttattggttggactatttgaatttgacttggttgcaacaattgcgggcggatcaactacattattcgctaaaatcatttacgtaattgtcggtatctgcgcgatttattgcttgaagttctttgttggtattgctcgtcaagacaacgtgaaccgataatcattgataaataaaaagcaagaaacgaatgatctgatccatagttgctctactttctatggatcagatctttttgtttgcattgccttttgtctctttttttatttgttgtataattagtgtcaacagcgaattaaaaaatttagataaatagattttggctggactaggaatagcagctcattcacaatgaaccgacaaaggaagtgacccatgactgataaaaaacgtaactccaagcttctcccttctctgcttttttatttcatcctcctgctcatcattgcaggaatcttagggatcgttgtactgacgaacatcaatattgccgaaaactggtttggactggatgagtacacagttgtagaaactcgcgaccaagtgatcggctatcttccgctactctggtacttcgttatagcactaatgatagtcttggcattattttttggtatcagaaaaagaaaaagggctttgttctattggatcggcacattggtcattctccctagcatcttgttagcatttggtgctttaacaaccttgctacccttcgaccgaaatttttttagagaagaagcctctgcttccgcgatcatggctgaattaaccgacaaaaaagcgctgaaagatcaagaggttcagctcatcagttatagctatcacattcggaacattcctttgaaaagcggcgtctatgcagtcgcgcgaatcatcaaccctaccactaaactacaagatgaatactggtattattcgacaaatcttttacaaaaatggcagaaagacagtgatacgatcgagttacctattcaagagaccattgcttataatgaaatcgattggggcgttattcccaaggttatcaaagaaacggaaaaacgggttgcgaaattagaccattattatcccggagttagtatcgtgatcttaaatggttctcaaggcaaatggacttggacggtcggtgtcgatgatattcggggacatactgcactgaatctggtttatgatctttcaggaaattatctttctcaatgggattaatcggtcaatacaggccctacttccatcatttattaagacagcaattaaacaaaaaactatctaagcgatcactgattgttcctatcaaaggacgacttgctaaaaaaagcaatgagacaatcaagattttttagatagtttttttattattattcacagatacgcctagcttttggcacagcgaaagcctaaattattggccgcagacatcccggagtttccattgcgggctgcgatccgataacgtttgcagtaagattcatgacacaagaacgaccctccccgtgtcgcatacatggcatcatccacctgctgaaatcgttgctcaaaaaaatggctgtcccatgaacgaaattgttccaatggtatccttgcgggattgctgcaccattcccacacattgccaatgacttgataaagtccatagccattcggctcataaaaccgagcaggtgcagtactcgcaaagccgtctgccttcgtatttgctttgggaaacgcgccttgccagatgttgcagtgatagtcttctccagctaaaaaatctgtcccccatggatataagtcattctctgtaccacctttcgcggcaatctcccattcagcttctgttggcagccgcttatctgcccagcggcaaaatgccaacgcatcatttcgcgagacttggacgactggatgatccatccgttgctcaatcgatgagtccggaccttcaggatgtcgccagtctgctctcgcaaccgcataccaccaactcatattggggatcagttggctcctctgtttcgtcttttcggaaagaaaataatgaaagacaaacgaccagccaaactgttctgcttccgtcacatagcctgttgccgcaataaatgcttcaaacatctgattggtaacagtcgtttcatcgatttcaaaagaggccatctcaacttggatcttgggaccttcttggtcctcttcaaagccagcttttgtatccgtgccaattcgatacgttccagcaggaatcttgatcatcccatctgccttctttctataataattgatagccgttataaagattgatggttagcaccaagaggatgactgtctggaagaccagcgtcactttttgtggtgagaggacagtgctgacttttgcccctaacaaaccgccaacaatcgcggctggaatcacaaaccacaaaatctttaagtcatagaggccaaatccagtggtcccagcaatcgtcacgattttcgccaattgagagaaaaaaatcgtacaaatcgaatagactgtcgcttctttgattggcaaagcaaacatcagcatcagcaaagaaacattgatcggtccgccgccgattcctagaagactggctagaaaaccaaggactaaaccacagaagcaataccagaagttatttttcagttggaatccgggccagtcatatttggtataaaagaaagcaaacaacaaggtcacgacggtcaaaaagatctgcaccatctgtacatggtcttcattctggaaaaacagcaacagctgatcaaaagcgacattgcccaagacaccgcctaagatggcgcctcctgaaacccaaaggacgatttgccaattgatcttatgtccgctagccaactgtcttgcggtagaaaccagcgacatagtaaagactgctacggcagaataaaacgagatggccgcaacagaatgggcgccgataaaatcaaaaatgggtttgatcagaacgcccccccccatgcctgaaacggcaccaaccgtattcgccaacacgatcactataaaataaatgaacccaatcacacacttcccccctgtaacaaacctaaaatccgattgatctgcggcacaaattcctgcaagagttgctgataaccgcaatagtccccatccacatagatggcatctttcattcgtttgcagccgccacgacacattttttgaaacgggcaactcagacatttctttggcatttcgggccgttgacacacaaacgtttttgcaatgtcctgttcaaataactgacgcaaggtctgttcttgaatataccccattcgatagtcatctaacacatagaaatcacaaggataaacactgccatctgcttcaatgacatattgcacttgacagtttcctaagatcccgcaggcggtgaattgttgcttgaccaataaattcaaaagatcatcaaaaagcttgatactcacataatgcccctccgctaattcttgcagccataactgcaaaagctggtggtaaaatcccgcaaaacgttttggtgtgagggcatagctatttctttctttcgcatctaaatcatctaaacaaggaataaactggacaaaatcgattttttgttcttttagaaagcgaaagactttcttagcctctttagccaatggattggtcaggacacaaagcacattgtagccaatctcaaagtggtcaaacagctgctttgtttgcagcactcgctgaaaagttcctcttcctttcggatcgacccgatgcaaatcatggtagagcggatggccatcgatcgagagaccgacccaaaaatcatgttctttcaaaaaagcacaccatttttcattgatcatggtcccgttcgtttgaatcgcataatggacctgtacctgcttttgctgttgatccactagttgggtcacttttcgaaaataattgaggcccgccatcgttggctctccaccttgaaacgctaatgtcaattgatcaccgtcttctaagtctgcataaatattttcgatcattttatctgttacttcttctttcattttgccaaacgagcggacttcccgcaaggaactgacattggcataaaagcagtagctgcagcgaagattgcagagggaagatgcgggtttgatcaatactgaaatatgtttcatggtagaagcctcgattctaaataactttttgaagttgctaatttatttaatttcttaatcccaaacgaatatattcactttctggcacttcaattcgatccatgatttttattaatttctggatcatcctttcttcaacgtcaggattatccagtggagtcaactgttgcggatcctcctccaagtcaaatagcaaatggccaactgaataagaatcaatgtatgtggagacttcaatttctgtataaggatactgatttgtgaagcgatttccctttctttgcttcatggtatctaatgcttccttattgatgaacccccttaacatcgcgtaattcaatgtttggatagtgattgggccgttggaaggatcaacagacgcacgcatatacacgtacttcccatcataaatattgacatgaccgccatttgttccaaaaatgatttcatcatgtaaaacagtctccttagactttagagctggcaataatgatttaccatccatatccaattcattcgcaataccaaaataatctaataaagttgcaggaatatcgatcgtttggcttaaaacagaagtatgggtatccacttcagcatttgggtaactgataaaaaatggcaaatggataatttcttcatacataggagcaacattctttcctaaccaatcatgctcaccaagaagaaaaccatgatccgtattaataatcaccaacgtatcctgccacatttgattcgtctctagaaaatcaatgacttttccgagatgatggtcacacattgctatcaatgcagcatattcgttttgtaattcaattaaatcatcggaagaaatgtcatctgtaacccgaccatactttggccaaaaataaggtgactcatttggacagtcctcataaagtttacgatatttttctggaacaaaaaagggttcatgagggtcaaagcattctatttgcaaaaaccaattatcttcttttttatattcttccaagaaatcaagtccagcttgaattgtttgaacactcgacatctcattttcatcaacttgtcttgtgcggttcgcaaaatgctgttcaactgaaatgccttgcttattcaaaggatttatttctgcatggccttcagcaaatttcctaggtacccagcgatcaccttcctgcccgcgaaacccctcccaagtagaatagcgattatgataggttgcccctccatcctcaaaatagtgagaatggtcggtcactaggtgacagtagatgccattttgttgtagcacatcaaaaatggaatgatcaaaaggctccaattgcccccacatgcgatgcataaagttatatcttcctgtatgaagttcacgacgtgctggcatacaaggcatacttcccccataaaaattatcgaaagtaaccgttttttcccttaagcgatcgaaatttggtgtttggatccaatcatttccataatttgacagaaaatcttttgacaacgtatcaaacattagcatgatagcgcgcatattttcccttcccttctttactatcgtatcatatagaacacaacttaatgaatcacttgaatgacttcattaacaatatctgggataacatccaaataagtatcagtatttgttacaacaaccggtgtgatgatcgagtagcctttggattgaattttttctttatcaaatcgaatcaacagctcgcctttccttacttgctgtccttgttttacgtaggaagtaaagaaatcgccttttaagttaacagtatccattccgacatgaatcaacaattcaatgccattcgtagattttaaaccgatcgcatgattcgttgggaacaatgtttctacagtagcatcgaatggcgcatagatctctccattgcttggaacaatcgctacaccttttcctaataacccagaagaaaaagcttcatcttcaacatcagccaatgtcagtaaatctcctttgataggcatctcaatctttgtttccgtcattaaataattatctattgctatctcttgctcttcctctgattcagcttcttctcgatcttcagtaggatcatacatgaatgtaatagttaaaacaaacgatagtgcaaatgccacactaattgcaagtgcatagccataaaaaccactgccaattccatcactaggactaatataatttggaagactaaaaacgcccattcctcccatgataaatgattttgtcccaaagaaccccatgatcagaccacctatggaagaagaaatcaaagttgcaatgaatggtttcttacggggtaacgttaccccgtaaagggagggttcagagacaccgaaaagactagaaataaaagcgggtataccgatcgcacgaacagaattatttttggatttaatgataaccgctaatactgctccagcagtagcaaatggagttgcttgtcctaaaaccattacaggatcgtatcctaatacaccaatattgttgatagcaatcgggataatcccccagtgaagaccaaacatgacaagaacttgccagattgcacccaccgctataccagcaacaatcgggctaaactgataaatacttaacacagcagcccctaaaatatttccaatccatgtggctattgggccaatcacgataaatgttaaaggaaccatcaataaaactgttagaaatggcactaaaaagctacgtaaaacgctcggaattaatttggtaatcactttctccaatttcgctccaaagaaagttgcaatcacaattgggataacgctagaactataactcatcagaataactggtatacccaaaaaagttacataaacaggtgactcaaaaatcgtaccattaaataaggtataaagaggttctgtattagcagttaaccctgacaaggccggatagaccattgccgcaccgatagccataccaacaaattgcttcagaccaaatttctttgctgcggtataaccaagaaaaattggaaagaaatagaagaagcagtcaccagcggcttgcaagatggcataggttccagaagtattttcaatccaaccaagagaaacaaagagaacgtttaatcctttgatcattccagtagctgccagtaaccctaatacaggtgtgaaaataccagaaataatatctataaaagcatccaaaggtcctttcttctcctttttttcttccgaggcttcgtttgataacccagcatagtcaataaactcttgataaacttctggtacgtggtttccgatgactacttgatattgtccaccactttgtactactgtaactacacctttcgtttttttcaatgctccagtatctgcaattgattcatcttttaaattgaaacgtaaacgagtaatacagtgagtgagaccggcaatattttcttttccacccacatttttcaatatttcctcaactaaatctttgtatgccattttattcatccccttattcataatcaaaaaggcaagacaaataattattcccaacaaaggaataattatcagtcttgcctgctttaccagtaacaacctctattcgttctctattaatttttgaatgggtagcgataagtataacttttcatcatcacttagagagactttcagatactgctcaaccaaaatcatcgttttgtaagctgctgggtattgactctgaatgtgctccagcaatggatttttgcttattcatcttagtccgggtagtcaatcgttggaagaaaaagcgcaaatgagtgataaagcgatcaaacgcaagcgaatcttcattgatttgaattttattagatagacgaataagtgaaataatatctctaattttctttgcaattagctggacatcttcaggttgatcgatctcatctgtcagctgagcattgatcaaatgcattgcaatattccctgcttcttcttcttcgaactggatacccgttttttcattaattaaaaatagtgcttttttccctatctcaaattctttgggataaaacttcttaatttcccatgaaaggcggttataaatactcattccctgtttgtgtaatttaatcaaatgatataaatgatcggttaaggatacatataatgtttcacttaactcatgctctagatcatttttagctaatcgaataatatcatcagctaaggaaacgtactttgccgggattgattccattaatgtcaaaaaacgttcagaagctttgtttttatgcaatacaaatactttctctattttcgtctcgtctgctgcttgtcccggtttcattttaaagcccagcccggtgccgatccaaataaaatctttgccatcttttccgaccaaaaccgcattattatttagaatctttttgatcttcaagacgtttctcacctccttaaaatgaaaaaaggctatacctcaatacatgtgtaggatccatacacacgtacaaaggtatagcctgcattatcagtaactacccatttgattgtttatactatactatttatttgattttcgtgcaagcgtttttatcatttttttctgcttgcatgtgttttgttgagtaaatactccattcctactcctcatccagtaaccgactttgtccttcgatcttttggatctctgtgatgtcttgcgtgacttccagacagcctagatatttccccgttggatttttcaacgcaaaatagcgaatatagatttttcgtccccgcatgtcaatccagaaatcagctgtttctcttttgtctgaccgaaaatcgtctaagattttttgaacgatgtgcatacttttaggtgggtggcaattcactacttctcgaccaatcactgaatttgtccgggggaagactcgactcttcccttcagaataaaaacgtacccgatcttcattgtccacaaacgtcaaatcgactggcaatgtttggaacatagcaatcaattgttccagctgcaaggaaccggtgggaaattgaacggtttggttcgtgggagcagtcgttgtcactggcggttcagcgaattctccaaacccaagtcccgcggcaataccagctgtggtttcttgggcctgtttgatggccaattgacgagctggctcccgttccaattctttctccagtgactcttggcttggtttccaaggcaatggttcaggaatataagcaaacccaatgtcaaagctatcttccgcgatccgttgccaatccgctaaactgaagacatccaatgtcataggaaccatgatttcttcttctttaaaaatcatttcttcaatttcagattttactgcctgccatttttcagcaagaggattatatgctgctttgtcagttgccaaatactggttcaactctttgatcatctcgcgaatatcatcgtcgactccccacatgactttcggcggagcagagatgccatacttctccatatatgaaaagatcagcgtttcttttcttgcataatgtttgtcgatctgtaacagatcctgcagtgctgcttgcagacgtcctttttgtgaccagtccccttttttgattttcttgagcaatccatcgatttcgtccgtcaataacgattgcaggacttggttttctagcttgagggtatggactggatgaccaggttgtccatattcttcatttgaatgatggatctcgttgatcgatcccttaaatacagccgcatgaatattgcatagacgttggatctccgaagggtctaaaccgctttgaatcaatgctttttctgccgaggtgatctcagtgacatctacgccgtcaaattcttcattgaataagcgtttggcttcttcaaaagaaccgccttgatgaagcaagctcaaaatttcgacgattcgttcttgccgttgttccttcgttctcatttgtcgactcctttcacaagaaaaccttgattttcaaaagattgaatgattttttccaaaggtatctttttcatttgtgcgcctttcggaatcgtcatatagcgaccggcagtttggagcatgccgggtttattgatggcagtaaagccaagtttgctcataatatctttgatttccggatgttccgacactaaatcaaagagattttttgagaaatctgcttctttcattcttatccttccttctactgagaataattctcaatcaactgcatatattatatacgaaattgctcacaattacacgatcatttccaaatttatctcccctcacttggcacaaaaagaaaagaaccacttctcgacctctgcgagcgaatgattctttaatagcaagatgaaactcttgatttagtgatagaaaataatcagctgcgatagcgacacacgcgattctctaatccatccaccacaccaaagaagaaaaagcccatcaatgcaatcacaacaatgcctgacagcatttgctcataatccattttagaccaagcactcaaaatcaagtacccgacgccataagtcgtattatagttttccgcaaagaacaaggaggcaagcgagataccaatacttacccgcatgctggcaaacaatgccggcatgattgctggcaaaatcaagaaacggatctgatgcagcgggttttgcgtgtaattttgcatcacttgaaagtaagttgctgggatttcttttaccccatctcgaatcgaaaccacaacttgaatcacgatcaccgaaaaaatcaggatcacctttgaaacattccctaaaccaaaaaaaatcatgaaaactggtagaaaagcgacctttggaatcggatataagaaatagagcagaggatcaacgattgctgctatttttgttcttccgagaaaaatccctaaaggtataccgatcagcaacgcaaaaaatagtgagatcaggacacgaatcacactggcccctgcatgtaaccctaattctgcacgcaattgccaaaatcgttggaaagtttgataagggtccggcagcgaacggttatccgctaacaagctgattccccaccataacaataaaaacgacagtgccccccacaaaaaagaacgtccggctttcatctgacttctcctctcatcttctttttcaatgccaatgaaaaagcataaaagtccatcgtctcacggcggttagcttggtggaaaactgggtttttgatctgatgtatttgatgttcttgaaccaataggatcgtctcgccaaggtaagccgcttcttctgtatcatgggtcactacgactaaaccgttcgcaagtcgttgttgctcagataaaatcagattttgcgtacgttctttggtttcctgatccaaagacgatgtcggctcatctaacagtaaaaatgctggactggtcactaatcctcttgccattgccactcgctgtttttggccgccactcagttgactagggaaacgcgctttgaaagaatctagttctaacgcttgtaagcacgtttcgactaacttttctctttggtttttggggactttttggatttgaagaggcatttctaccgcttgataaactgtctgccacggaaacagacgtaagtcttgaaaaaccaattcgatctcagaaggatggctatcgccataatcgatatgacctgattgcggcagctgccaccctttcaacaatgagagcagggtgcttttaccaacccctgattttcccaagacgacgtatgtatggcccttatctaaggttaaatctagattgttaaagattaagcgatcttgaaatgaaaatgcgactgattctaaatgaatcgccataaattggctccttctttctaaaaaattgttgttccctctttcacattctatgctatactgattgttgcgaaaaaaaatagaaagggatgcatttgatgttccgcacacttgtgtttcatgaaatacgaccagacaatgagttaagtgagcaaccaagaccaatcgaagttgccgatggctatcaagatgctcttccattgccgttattcaatagctgttctcattttaaacaacaaatcgactttttgaaagcagaaaaatatcatacccttactttggaggaagtcaaagactactatcttcaaaagaaagctttaccagaaaaagcggttttgttgacgtttgatgattgctaccaatccatgagggaatatgcctacccgttattgaaagaggccggcttcaaagcgaccgcttttgttgtcagcggttggttgtttgctgaaccgagcccttataagccggctgtttccaaaacactcagtcgctcggaattgaacgaaatgagtgatgtttttgaatacgccaatcatacgactcacttccatgaacgaaaaggaatgatgggccgctcaatgtgggaaccggctgaaaaatttgcggctgatttagattgctgcaatcaaactgtagcgatacaagatgtttttgcttatccctttggtttctatgatcaacagacgatcaaaacactagaagcgaaaggttttgtcttgtcattcacgacgattccagggttcaacaccctagaaaccccacgcatggaactacgaagagacattattcccttctcattggataagacatcttttgaacaattattcaaaaagacccattaagaacatcccttcaaggaataaataagaaagaggaacgaaaaatgaaaaaaacgattttatttacttgcttatcattattggctttagtagttgctgcttgcggaaacaattcagattccacttcagaaactaagacaactgacacctctgcgacaactgctgaagtgaccgatcaaacgttgaatgtggggattttaccagcagaatctgcgattccaattattctggccaaagaagaaggctattttaaagatttaggtctaaatgtagaaatcaaatcttttacttctccaaatgatcgcaatgttgccgtacaagccaaagaattggacgcaactatcagtgatgtgatgacagaagcgacgtttaagcaaaatggcattgacatgacaatcacttcggacattctagaagactttaaagtcttagcttcgccaaattcaggcatctctgaaatgaaaggattggctgataaaaaaattacccttgtaccgaacttcattttagaatacatcatggaccagtttgctgctgaaaatgattttacttatcaaatcgttgacattgcttcttttgcggctcgttctgaggcactattaagcgatcaagttgatggtgctgtctacacagaaccgcaagcgagtatgttagccgctcaaggtgcaattgttttgggcagttccaaagaagctggcatcaaaggtggtaccttgcaatttatgactgatgtggtaaaagatcgaccacaagatgttgccgcattttatcaagcttacgatcaagccatcgattatatgaacagacacaaagcttctgaatatgctgatatcttagccgactatcagttcccagatgccatgagtacttacttagatagccaaaaagaagactatccttatgctgccaaagtcccacaggaccaactagacaaaatcgtggcttggactaaagacaaaggacaaattgatcaagcttacacttatgatgaattgactgattttagtttcttagcgaactaattcctgatcacttattacacaaaaccaatactcgaatccatcaaagccagtgctgtgatagattcgagtgttttttatccagccattatttgacggatgctcggtcaccgagtatcattcactaaagggttgtgagcgatgaaaactactttatctgttcgtttcactacataagaaagggagaaaatataccatgcccaaaattgatctttatttactgcaaaagccagaagagacacaattttatgactatttacctcaatcggagtcttggcacagcgcctataaacaacttcatggtgaatccttggtgattcattcttctgttttgactgaaagcattctgcctttcattactcacccacttgtattggaacttctagagcaagaagatctcgcgtgcttgcctttagtttttgcagaaaacaacctttattgtaaggggcgtcttcctacgctcaccgaatgggaagaattgacacacgttggtatttcgattcaggaattagatgaatcaccgagcgccacgaaaacagcggtctatcatgatcttatatgatggggaaaactatctgctaaactgtcgttggtaagccttctcctgatgaaagattcggtctttatagctataaaaaacaactatgaatgagagtgaaattatggaaacgatgacttttgaagaattaatccaaatcaactgtttttctgaagaaaaagaagaacgaaagaaagcagctgaattattagaatatcgttatggctgcgagattcgttgtggtgagatggacaaaagtgtccgctttgctcaccatgctcgcggctgtacgatcattgctgcgaaactttgcgccaatgttgtgattttccagaatgtaacgattggttcaaatcagcggtttaaccggaaaaagaatgcctgggaaaatctgggcacacctattttagcagaaaatgtaatcgttgcagatggtgccaaaattcttggcccagtcatcatcggtgaaaattctgtgattggagcaggcgccattattaccaaagacattcctgccaatagtgtagcctttggcgtcaatcagtacaaaccaaaaaatcccgacttcgatcttatcatcaatgaccaaaatatccctggagaagagatcatgcggatcaacgcagaacgcgtagccgcatttaatcagcaaaatcaacgctagcagatcatccgattatcgctagcaagacaaccaaggaattataagcgatatgagcaaacacagactcccatggatttttgttgcgcaaatagacgattgtcagccaaaatccaataataaagtaagggtataacaaaaaaatattaccattagcattaacaatatgggcccacgaaaacaacaaaagactgcacaatgtcgtaacaattctcagccatctttttctaccagtataaataagcgtatagcgatagaacatttcttcgaacaatgggcctactactaatgcccccaatagtaaaggaacggttctctgagacgatggataataaaaagtcattgattgttcacctggaaagataatctggttgaagaaaaccgttgttaaaagaatcgctacaaatgtcagcaagcctatttttatcaatgagagaaccttcagttcttttaaacgatccaacaaatccctataaaaaaggataacaaagaaacaaagcaacactagcttggcgcccaactcatgatagcccattaaaaatttcgcataggaagaaggaattccatgtatggctattcctttccagataacaaaagccaaaagaaaaagcagtttcttcaagtcttcactcctttttgagtagtttcactagaattgcatggtgcttcgcttcacaattaacctctatcaggattcttctcgttccgttctttctcatgattctctttgggtagtttttagatcattctcagcatttttttactcacactacaattatacactataaaaaggtatcaaaaaaacattcatccgaaagaatgaatgttaatcagacatttttttactgaacaatgtcattgactgattggttttttaggaagaacagaaatgaccgttctcgcgaccaagagatagcaccagataacaagaataagctaatggccgttccttccctcacaaccaaaggaaatgaaaaagctgtagaaaggccgattgagattatgacacacagcacatcaacactataccgatattgtttgaaggaaaagcgacttctatcagccatcagctgacaaaaattttcaataggaaatttcaagtgattgagtcgcaacacttgtcccgtagcgagtcctgaaatcaatgtcccaacgataaaacatgtgacttgtgccaaatagtttggcactatcagttttggcagtaagccatataaaataccattgactaaattgccaaagaaaagcaatgctgccatcataatcaaatagttgatccatttccgataacggtttttttgactgtggtccagaaaccaacaagtgactaagaagagcagattgatggctgtcgtaatggttccgaccttgatacctgtgattgtggatagtgagacattcaatgaattaaagctgcttacaccaacagctgctttgattgtcaagctgatccctaatgcgctgataccatagaaaaacagtgaccaaaagagggttcgtttcatatgagatctcctttcatttgctccttctccattatgtggtatgctaagaaaaacaactaggagatttctcctagaaagagaggaaaaatgaaacgaaccctttatcctgttgccaaaaagtttcatcaattggacttgcctttttccactggaacattagaacagtcctctgtttacgagttttctcacaacgagatcatacaagaagaagccgggacactgactcacttgtacgtgatccttgaaggaaaagcaaagattatcaagtctcaagccaatggcaaacgatcgattttacaatttttgcattccggtgatttcatcggagatctgaccttagtgtccgctgaaaaaacgaccaaagaagttttagcgatcggtccaactgtttgcttggcgcttcctatcgatcatgccaagcaagtattgatgcaagacattgattttgtcaaaatgatcagtcaatatattggcgataaattaattagacggatggaacatttctccatcaatcagacttaccaattgaattatcgtttggcgctgttgctcttggaagtagctgtagcgggaatttatcaagaaaaactcacagaaacagcagaataccttggtgtcagttatcggcacttgacctacacgttaaaaacattcaaagaaaacgattgtgtctatcgtgaatctaggggttatcgcatcaatgaagcaaaccttaagcaattgattcgatcgatgcaacgcgaatagacacgctcttttccttctatcacgcttctttgctgattgcgcatgctatttgctaatttgagaatggccacagttgaatagccaaactgccagtccctgagaagacgatttggtcttgctctttttgcggataaagtctggaagtaaaggtatactccccattgtttatgaacacttccatcgatgaagtgtccataaacagttggatctgtcgtaattctgatagttgaatgcttctttttttgcgtccatagccggaaggcccatgagaaagagtaaaaatatggccatcataagagagaatcgtgtcttggcgcaagagaagctgcagtttttttgtctgttgggttagctctacctgcagttcgtagacctctccagctaattttggagcagtaaagctatcctttaactcgacattccagaagaaaggctttccacgtaatttttgatattctggcaatggttgttggatcaatcgttgtccattgaagctcagttctcgcggcaatgtcgccgcatgctgccatcctcgagtaacagtgggattcgagtattcaggacttgtgtcccctagtcccatccagccccataacaatctgcgccctttttgatccaagaacgtttgcggagcataaaaatcaaaccctcgatccaattccacgaaatccgatgttggcttaaatttcaaatttttccaatctacttcccctaataagtagccagactggtataaattattgaaagcataagcttgcggatctactccctgtggtgaaaaaagtaaaatatcttgtccgtcaagttgaaagaaatcgggacactcccacatataaccaagggaataatcatcccctaaaaatatcccttgatacgtccattgtgaaagatcctctgactgataaatcaaaatctttccttcactttcccgagttcgagcccctaagatcatatagtaacggccctctttttcaaatacttttggatcacggatatgatcggtaaaccctgcaggatatgcttcatgcgggatcactacttcttgtttttcaatcgaataaccatcactaatcacatggaccgtattttgttctctgccactaaaagtataatcatggtccccttcgtttttcacatttcctgtataaaagaaatggatctgatcatcctttacaatcgcactgccagaaaatacaccatttcgatcatacgaatgttctggtgaaagaaaaattgcttcttctttgaaatctaccaaattggttgacgttttatgtccccaatggggtgcttcttttcctgcaggattttgaggaacatattgatggtagaaatgataaaccccattaaactgacaaagcccattgggatcattcatccacccagtttccggcattaaatgaaagtacagtcgccagttatcctgagcgatctttgcttttagttccgattgttgttccagctcttgccaggcttcttttgcacacaaatccatccaccactttcttctctacaatttttccattaattctcggttgcgcttaacgtttgaaggtcatcctcaatcgttgtttcttcattcaattcatcggaaatctttctccgctgcagttggacgcaggcaaagcccacactaaacgcaatgaggatcactgcaatgtatttcaacatggcgccgaaatctcctgtatacaacaacaaaccaggaataaatgtaatgcccattcctgttgctgccaattgaaaaacatacgtcatcaagccgccgatggcccccccaaccatgccagaagcaaaaatacgcaaggaccgaagattgatcccaaacaataatggttccgtgatcccaaacaaggttggtacagctgcactaatggcattcgagcgtttgactttgtttcggtaaagaaaagcagctgcgattgctgccccaaattgtcctgccatactcgctgttcctagaacttgcaagacattctctcctgaagtatttaataaaccaagttcgatgatgctcaatgaatgatgcaaaccggtgataacaatcaattgctgaaccgctgcatataagatatagccaataccaaaaggcgcttgtacgaggtaaacaatgccgttgatcactgctttttctgcaacttgcaaaatgggacctaatgcaaataaaactaatgtcagcgtcactacgatagtcagaaatggggtgacgactaaatccatcatttgtggaacaaattttctaaatcctttttctaatttggaaacaagccaaccaacaataattgcggggaaaatcgaaccttgataccctgaaatagaaagaccgaataaatgaagcggctgtgcatcgccactagcaactgcccaagcattgggtaactgaggagctaccatcatcaaaccaacaacgatcccgatgatcggattaccgccaaattttttggtggcactataagcaatcaatacaggtaagaaagcaaaggctgtatctgtcagcatttcaaagagcgcataccagtccgcactaaaaggaacccctaattcaactagcagaccacggatccccatcaaaagtccagttgtaactaatgccggaatcaatggcaccaacacatcagaaagagtacgaacaactttctgaacaggcgtcagattggaataaacatcttctttaaaggctgtctgctgctcaccatctttacccattgtttgagcaaaagcctcataaacttcatttacttttccagtcccaaaaataaactgatgctgtcctgtattaaagaaataacctttgctttcagaaatgttttctgccttctttttgtctagcaacgcatcatttttcaaaataatgcgtagtcgagtggcacaatgctcataatttttaacgttttccttaccacccactgcttggagcaactgatcaatgattttctgatctttcattttaattttcctccatttcaactcactttattttgtggaaccggttctacaagaaggataacagaaaccgtttgcaaaatcaacccgttttatcaaaaaaaaaaagactgtgacaaagtcatcatccaacaagttaaaccgaatcatatgctattgtgatagattcctcggacttttgcgacgaggagccactgcaccgcaggagccataatagagactgtgacaaaatcatcatccaacaagttaaaccgaatcatatgctgttgcgatagattcctcggacttttgcgacgaggagccactgcaccgcaggagcaataatagagactgtgacaaagtcatcatccaacaagttaaaccaaatcatatgctattgcgatagattcctcggacttttgcgacgaggagccactgcaccgcaggagcaataatagagactgtgacaaagtcatcatccaacaagttaaaccgaatcatatgctattgcgatagattcctcggacttttgcgacgaggagccactgcaccgcaggagcaataatagttaaggttcggatagtgttacttgtcggagacttatggcacagtccctttcacgaatcattatggtatttgttctatgggaatcgttgattgtttgatcaccagttgattcggtaacttaatcaattctggcacttgaactttttggatcaacttctggatcgtttccaccgcatcgacacctaactggtggtaaggatagtgagtggtcgtgatcgtcggaaagacataatccgtcgaatcatatccaccgaagccgctaagggagaaatcctccggcactcgcaagcctaactcatgcgcggctttcaatacggcaacagcaatgttgtctgtggcacaggctaaataggtcgcttgattctcttttagaaataagcgagctttttgataggtttcacttctggaaaaagacgtttcgatgaaagataatttggtcccttccatttgagcgaccacatccgtaaagcctttttttctcaagatccctactgcttcgtctttttcagtcactccgataaacaaaaaagaccgatggccgagttcaattgcatactctgccagtttctctcccgcacgataatcatcatggacaatcgaatggactccttgtaagtgttgacccaacatcagtacaggaacggtcaattgctgcaagacttgtgctagctcactcgtgatctctctagccagcataatgataccagcaaccttttgcttgaccagcatctcaatattttctaattcgcgttcttcattttgattagaattcgtgattaacaattgatacccattctttcgagctgtttcatcgatcccttctaacacactgttggtggaaggagaatccagcctaggaatgatcactcccaacagttttgtgtcttgtgcttttaaactgcgggcaaacgtattgggccgatagccggtctcttcaataattgcatcaatttttttacgtgtttgctcgctaacatagccattattcaaatagcgggaaacggtgcttttcgcaacgcctgctttttcagcgatatctttaatcgttaccgttaccatagtcaccctactttgctttttcttttattataccaagaactgaaacaaaaataagcactgattctctttcggatgccattcacttcatcaaaagataggaagccacaaaaaaagatgcttgctactcatgaaagagctagcaagcatccgtttatttctcgtgatcaaacgttcaagatccacataaaaccaataaagacaaagaataacacatacatgatcggtgaaacttctttaccacgtttggccgcaatcattgtgattggatagaaaatgaaacctagcgcgatcccgtcagaaatactataagtcaaaggcatgcctaataaaatcagaaaagaaggaatcgcgatttccatttcatgccatttgatttcttttagtgattgcgccatcagtactccgacaataatcaatgctggtgctgtaacctgagaggtcactactgataaaagcggagaaaagaatagaccaaacaaaaagaaaatacctgtggtcacagctgttagtccagaacgaccgccgacagcgatccctgctgaagattccacatatgcgcctactggagaagttcctagtaatgatcctgccaacatcgctgtcgaatctgacgctaatgctttccccactcgaggcatcttattgtctttcatgaaacctgcttgattggctaaaccaactaacgtaccggcagtatcaaagaaagtgactagtaagaatgttaggacaacgacccacatttgcaatgtgttgatgtcaccgacatgcttcaatgcgactaaaaaagtcgacgacatactaggtgctgccgaaacgatcgaacttggtgcgtggatcaaacctgtcactaaaccaagaatggtcgtcgctgccatcccaatgaaaatcccgccaggtactcgacgaaccatcaacacagccgtaatgaccaagccaaagatcgttaaccatgtcgtacctacactcaatgatcctaaggcaactaacgttgaatcgtcggaaacaatgatcccaccttcactaagaccaaggaaagcaatgaacaagcctatcccaccagaaatagcatatttcaagtcggaaggaatcgcatcaatgatcatttcacgaagtttaaaaatcgtgattgcaataaaaatcagcgaagcgacaaaaacaccggctagtgccgtttgccaaggcacacccatcccgatacagactgaataagaaaagaacgcgttgattcctaacgcaggagctgtcgcaatcgggtattttgccaagactcccatcaaaatacatccgagggcacttgctaatgctgtggctgtaaagaccgctccctcatccataccagaagcaccaaggaccgttggattgacaaaaagaatataggccattgaaataaatgtcgtgaatccagccaagagttcccgcttgatggtcgtgttgagctcatcaagcccaaaataagagtgaagcacatttttcattttttgaatcctccattattcagataggcgcgattattttccctctgaatccttaataaaacaacgaaatcaatgatataccaacttttcctccaagtaaataaacttttctaaaaatttcagaactattttcattttcatttaagatgctaaaaccgcttatttcccatacacagtgcctcatactcgttatgcttcgattgtaccacttgaatagtaaaaacaaaaaaagtctgtactgtcagaaacaaaaataggcagccaaagaacgatcatcttttccgcagaaaagccaatcctacctgacagaaagatcctatcaggatttcttttgctgacctattggttaaactgtttttgtgaatgatcaatccacaaaattttgctcttcctcaatcaaaatctttaattgttctgctgtcgttcgtttcattgacaacggcggcaactcttccaacgtaaagaaaccactggcagaggtttcactgttcgtcacaaaagaaccttctttgatcgaacaggcaaaaactaatttataatattgaaacaattgtggaatgtctttgcgcagattagtatcaaatactgcacaaagtttgtcaacttcaacaactaatcctgtctcttccaacacttcttttataacgttttctttgggtgagaaaccgacttctgcatagccacccggtaaagaccactcttttgtatgaatgtcttccactaataagactttgttatcctggcgaatcaatgctcgaacatctacttttggtgttggatacccttcattggcatctagcacaagtttaagcgtatcggttgtttcttccgtcgatcggctcatcaattccactagaatttctttcatttcgacataacgctcttgatcataaatatccttgccataatagatcccagcatcagcgattgctaacaatcgctgatacttctcaaaaatctcctgcatctgctcccctcgctttgtgctctgtcattctctctttatgataaagcaaattctggcagatagaaagccagacagcactaatttctaaagtcagctagcataattcaacaagcaatcattctttgcgatagatcatgctttgctggatttgctttaacgcaaaatccatgagaaaaatcaatcccatagccaataaactaccgatcaatgttcccgagaaacgccaaggaatcagatggagtggtacaaaactactgccgatagtcatcaaaagcagcacttgcggattggtaaaaaagttggcgatcgtataattgacaggcatgaaatattccgtcaatacattcaatacaatcaaaatagcagcttttgcttctaatggtaaatccagtgccatgagtaagaaacctaataagagcccaactattcctcctagcacacgaccgattgttctttttttgatgttttccatatgttcgccagcgagtaccgcggctgcagaaatcaagatccaataaccattgcttgctctcaacagatatccactataagtagcaataaataaaatcatcgaaaaatgcatcgcttttaggatcatttccggttggtggtaaagagcgacataatacttatctttgagagaaagctgctgaaagcgatctttgggtaaatgaaaaggcagcctttctgcagcggagatcagcaacccagccgccagagaacctacgattccataaagaagataggagctttgatgaagaatcgccagtaaagcagctgtcacattctgtgtttgatggtgaaaattgaatcccgttgcgtagagcatcagtacaaagaaataatctggttttggcaagcggtagattttggaaagtaaaaaagccgtgaaggacaagcagccgataataaacggtgcactccaaggaatcaatgaagtaatcgcccctaaaataaaggcactcaacaatgcaaaaccgtggatcaggattgcttttatattgtaactgaaggaacggtgctgaaaagccaaataagaaaaagctcccatggctccaacagaacaaatcatggggtctttggaaagaatcccagtaatcaaaggaacgcccattgcgatgccagagcccaatggacgtaatagtttggtagttaaattcatgacattcctcctctagcccctattgggagcgacatcttttataagtggttgtttgggaaaaaattagtatgtaaatgatcagaagaaaacaagatcttcaatgaaaaacacggcataactgatgaagcaagctatagaagatggaagatttttaacaatgaaaaaacaagcagcgactttctagcagagaggcaacggcctctctatcaattataggaatgaaaatcgaaacatgcaaacttttcaagaaagtttcgtgaatcacttgatctcagttaatctatcagaaaagacagtgctctctcattgccgtcaattatacggttcaagtgatataaaaaagatcaaaactattctggagcaaacaagaagttgcactcagttagttttgatcgaattattttattcctctatctcctttaggataggaaaaatttagtcctcttttattttacagatgcactagaaacagcatcgactacgacagcctctggcgcaccagttgtcgtagctgactctgcgttatcttcgtggacagaagcactggtaacagcatctgagttctcgtgaacagaagcgctagagacagcatcttcgtttcccaccaatttttgaccggtttgttgcagataccattcaatgattggtttgaaatctagaatatactcgttgatacctgcatattcgccattttcatcatgcatggcttggtaattgtggacgatgtatttctctggaacctgttttggtacatgaacccgaacagcatctgtagcgccgctgcgcaattgttggatcacccattccacatttttatatgatttttcagggtgacagtttgctaatggattgcccacctgaccgggaacacgagctgccaacatttcatgggcttcttgacgcaagttataatacaagaattgattattgctatccgcaaaggtcaactccatcggcattgaatctaaaaagtaattgatttgatcgacggtcaataatccacgatttaactgaacgtaagtatttccagaaacggcccctactgcttctgcagctttctcaagccattgatcatcagacatatcaacgccttccaccgttgtagcgatcttcccagtcgcatgtaaatcttctggtggcaattgtttaggtccagctaatgcagagactacgttaataaatttgacgaagcttgctaacgtgctgcctaaaaaatcaattgttcgttgatcgatcagattcccatcttcatcaaaagcttcttttgactttcctagtaaaaactcattccccggcatcacaagtgcattgactcctggggcatccaagatttgacgcaaatgcaactgtgatctggaagttccttgatcataatacgaagcacccacgaccattactggcttattttcaagaggatgaatcttaaatgaaagccattccaagacacttttcaggcctgctggtactgtatgattgtgttctggtgtagcaatgattacgccatcggctaaaatgatttttcgatttagttgctggatctctggactgttcgtttgatcatcatcttgattgaataatggcaaatctttgatttcgaccagttccaaagtaaaaagttcggtgaattgttttttgatgaatgttaataattttcgattggttgaaacttctgctgttgatccgacgataccgattaatttcatcttttctatctcctatcgcaattaaatggtttcccaagaaaaattttctgcttcacgtttattagcttgatgggcatgttgtaactgacttgtgatcgtcacaaacaagagaaaatcactgaatagctcccgcaattttgttacttgctcttcatctttcaggcgtccttgttcatcaaaagcttgcaatgagtgccccaaaagaaattctgaacttggcatgatccgtgcttttaattccggtgaatctaaaatctgccgcaaatgagcctgtgctctggaagaccctagtgtgccatacgacgcccctgtgatcataacgggcttatcaacaaaaggaaaaataccataagaaagccaattcaaggcattgatcagcgaagctggaacggcgtggtcatattctggggtactgatgatcacgccatcagcagcttcaattttttctgcaatccttctgactgcttccggcaactcatggtcttccggcttattgaataagggaagaccggcgatttcgacaagttcgatctccgcttcactagcaaaaaagtttttcatgaagtttaacaaatcgcgattcgttgatcgtgatgagttggttcctactaagcctataaatttcattttttattcttcctttccaaaataattttctttgatccctgacgtgtggcagacccgattctcccttgtgacaaagattccttcgattccggtctgagctttcaattgatccaccacttgaacgatcggtttaccaaataaacgagttgtccagatttctccttccaacgatgacttagaaacaatggtcagactcgctaagtcacttttggttggaaagcctgtttttggatcaatgatgtgatgataaacggatgctccttgctgtaaatagcgttcatagataccagaagtcacaagagaggcattcttgactttgatgatctccaatgattgctgccttgttccttgggggtctcttatacctatacgccaaaaaccatcctgatgttttggagacgcgccataggtcacgatattaccacctaaattgatcaaagcataaacagcatggttctgatgacagtacattcgtaatttatcagcaatgtagcccttagctaatgaaccgaggtctagcagcattccctgtttttccaagaagacactttgctcttcctcattcagacgaatttgttgcgggtctgtcaatggcaatagtgcagttacttctgagggtgtgaggacttttgcatccgtaaatccgatccgccatctttggacaagaggaccaatcgcaatattcaagtgactgtctgctgcacaactatgatatttgccgattttgatcagctcataaagttctggatcgacgaccacaggatgttgaccagctgcgtgattcaccgccatcaattctgagtggggatcgtttgcgctaaatcgtgtttcatattcatgcagcaggcgttctaattctgatagcaaccacattggatcgttatgggcaacttgtaatgtgatggttgtacccattctatgaatgacccttgtttcttctcgaaaaaagttttcacccatttgtatcccttctttgattccaaaaatcaaacgactcgctagcgaaccatcatttttgttagtattttcacaatcagagaatactcctttaaaacatttttgtcaatatcattatatatttttttatatacaaaaccgcgctaatcttatataaaaaaaagaacaaccttcgatctttcgttgctagatcaaaggttgttccctataaaacggatcaaaaataacgactcattttcatttgctttagtcatgcatcattatagctgttttttcatctgatttaactcattgatcaacagccgatttttgttgatttttgcaaacgcaagtgcatcttgtatcaattctagaatgacagaagctggttcgccggcagcttgggcatttttggccaactgtgcagctgcacgggccagataataggtcaaatgattctctgagcaaatggcgatcgcataatttaatagtgcgttgctggtttcaagatcattcgtttgcgcgtaaaaaaccccgcaatggaaaacgatattcaaaacgcgccagatgtcttccgttgtttggatgggatacgtataaatttcgctaaatactttatcgaaatatacttccgctttttccaactcagcttcacgcgcataagcgatgccgatccccgtgtaggccagcagttgaaatactgtgtcggtcgtctttgacatcagcaattgatcaaaatggaacaagacatccgtgaacggcgcctggttaaaaaccatctcgaatcctttaagataataataacgagctcttaaatcggcgtctttgatcgttttgggatcgattttctccaaaatttgagccaattgttcaaattcactggtaatcagcgaaaattcagctttttctagttgttcatctagttgtgaattcaccacattgattgaagaaaaaagatccactaaaggcagattgattcgattgcataacttgatcaatattttcaaggaagggacttgtccattattttcaaacctgctcagagttgcttgtgtgcaaataccctctgaaagttctttttgtgacatcccaacagcctttcgtgctgcaataaatttctctacattcaattgcctttcccctctctgcttcaactttggcagccattcagtatcgatatgattttagcatgtttttttgaaaacaggcaccctcttttgattttatttttcacttgtgaaggggaagattctatggaacaatcacttttctgagaaatcgccttttacgacagcccgctgggtttgatagcttcctttctcttttcctgtacgtatctcggctagctttgtttcgatcattttcataattttgttcaagttttgagggtctgctacaaaatctagttcatccccattgatctgcattttcggacagacatcaaaattttcataccaagcatcataccgttcgttcaacaatttgtagtaatcatacaaacttggatcatttgccacctgttcatacgaacgtcctcgcttaccgatccgatcgatcatagtctccaaagaaactttgatgtggatcatcaagtctggttgtttcattggggcggagtcttccaactcacgcagcatcgtgttcaataaattgtcgtattgctcgacttccattggtgagatccttccaagatctgcattcaaatgaaacatcatgctgtcttcataaatcgaacggtcgatcacattgtcatcgtgagacaaggcttcccgcattgcaagaaaacttttattcaaaaaaaagatttgcaacaaaaaagcatatctttctggatttgagtagaacaatggtaacacatcgttgtcctcaacattttcataaaatggttttgaagccatttccttcgataaaaaatcggtcaaactacttttacctgctccaatcgttcctgctatcaataacacatgcatccatccttcttactaaaatatcgttgagccatccttgtctcgctttttccctcactgataaacctaacactgaagctgattcaaaacgtaggcgtatctttacatggcatttggttagcagcaaaatactcataaaagaccttgtttactgatttctctttgataacaaaagatttctcgcgactaatgtctcagtggcaacctctctagtgtatcaaatccagcacgtattacaagattgaaggtcctttttccaataacgggcactcttctgctaacaggttgtcgtctaaactcgtgcgtttctcagagtcgtaatggcggattctttatgcttgtttgcctcacttcgacacaaatccctgctaaacgattatgacaaaaacagcgctccttccaaacttcaagatccattttacctaatctttaaaaaaagtaaatacaatatatagtgaacagagtgtaagaaaaagattaaaaaatactatatattgtgaagtaatggtatctaaaggaaggaaatattcagtcactgcagctgattttgttattcattttttcccccaaaaaaaacacaacacctgctctcctatcagaaaaaagagcaggtgttgtgtttaaaatgttgctattccacttcaatggatcagcaatcagtcgtttttgtccccttgaatcaaaaaacaaactctagctagggtatatcctttgtgtcagtgaactgatttccgcctctttccactaaagaatatctttccatgatccttaacgtaagatttcgatcgttttctcgattttaaccgttacacgaccgttcttgatcacataaacccgttcgggaatatcaatcaatgcattgcttttcgactttgtatctaacaatacaagatcggcttttttaccaacagctaatccataatcagctagtttcaacgctttcgccgtgttggtagtgatcatcggtaaaaccgtcggcaagtcggcagccccacctaagtgggcaactggaacagctagcatcgcaatctgaatcaagtccccattcccataaggtgtgaaggcattgcggatgttgttgcttcctaagcagatatttacaccaccatctcttaatttgcgaatcggagtgactgcacgacgcacattataaggatcgtttctcgcccctaaatgaagatcggtggcagacaatggcatgacattgatttgtgcttccgccatcaatgagatgacttctgctaatttttcaggcggcatcgcatgcaacgcggtcaaatgacctacggagacacgcccgtgatagccttctttaatggtcttctcacacagataaacaattgatgtctcatccgcttcatcggcgaaatcttgatggagatcaatgtctttatcaaactgtttggcaatcgaaaaaaccaaatcaatatgctcattggctggtgcatcattataaggaattccccctacaacgtcggcacctttttccattgcttcgatcatcatcttatcagtaccaggcgccttgaagattccttcttggggaaatgcgacaacttgcatatcaatcaaatccttgtattcttcttttaatcgcatgatcgtatcaaagcccgtaaatccttgggctggatcaaactctgcatgagtccgcacagctgtcgtaccatgaacgatcagcatctcaagtgcttgttttgcccgttggtatatgtcttcctctgtgaaagttggctttaattttgcagtaaccgcgatagcttcttgcagtgtgccggaattgttgggttcacggtcagcgatcaatgctttatccaaatgaatatggctttctacaagaccgggaatcagcactcgtccattggcttcgatggtctcatttgcaactgtttcgatggatggtgcgatctcgacgattttgccagcagtaatgccaacgtcttttaactcttctccatcctcgattcttgcttgtttaattagtagatccatttcttttcctccctcttacttacccaaaaatcaaaccaatgaacaacaatataattgaagcaagacttagccatttcacatttcctttgaccacatccaaaatggggatttggaatcctgaagataatgcttgcatcgtgatgttgacgaaactcatttgactgcctaagcccacgcccattgtgacaaaacctaaagcaatcggtgggaatcctagggaaacggcgactggcaaaacaagtgtcaacactgagcccacatacgctccagcaggaatgccaatcaagactccggttaaaatcgccacaggtactacaacaaattccggtgcattttgagctaccccagcaatgacggcaaacgttcctgtttgcgcaatgatattgatgaatgccaagaagattcccacttgaaaaagacgagtcagaatatacgttgatccatctaccattgcttccaccgattgattcattgaaaaatcagtacataagtaaatcaatgctaatgtgatcaccatataaacaagcggtgtgaagaaaacaaaaccaatcaactcattgactagcgggccgaatataactgcaaaaagcaagaaaatcgctggtaatgtgattttgaacaactcgccattactttttgtttcatattcattttctgcagaagctttaaagccgatgtgccggcgcttcgttccccaaaaagccaaagcgatagctaacacgacaaacaacaaccaaaaaggacgcatctcaacaacataagaagaaacgctaaagccgcccagtttggaaacaatacttgattctaaggaggcaggagaagttgtaaacgagacagctgccgctagcgacatggctgcaatcaattctggaaccactcccactgctgcaaaagccagtggtgcgatcaccattgcactgccgccgccaataccagacatataagtagctgctgcaagcaaaatgacaataaatgcagaaacatattctaccttgccttttgttcctcgtttagccaaagtcaaagctgccgtatagcttcccgctttgaaaacagccattgccacagcagaattgatgatggggacagtgatactcaacatcgttggcacagcttccagcagttgcgtattggcttctgctaaactgatacctccgatgatcattgctagtataccagcaaccagtccagcaatgatcatatctacctttctaaataaaagaactaaaaccaagaccaatggaactaaaaccaaaatagctttaaatcctgttggtgcaacgatttggtcaattgcttcttcagcatgtacagcaatgccataaaacattcctacaaacatagcagcaagcaaaaaaacccattttttaaatgttttcatttttccacgtccttttttggataaaaataaatgcattgaaaaaaacgaatgattcagtctattacgtaactagcaaaataggttattccatttagagaaactcaaacggggcctgctttctccttttataaaacaattactgccgattacctattgaaatcaaaatgagatcactcttaaaaaactacccctttcactacttgctattcagctacaagttctctgagccactcctccctaagaatcattccctgcactgtccactactaataaacggccacaagatgccgttggtgaatcctttgaagttgtcggacatacaaatacaccgcttttttgtgggaatgattcttccttttctccttttctgcctatcttcctgttttctattttacgcgaatgtgaatccgctttctttggacgttattctaaaaaaaacgatctttttttagccgattgtctaaatcatttgcatcaaagtgaaacaaaagcggctgttctgcctattctgaccagccacttttatcaattatctggttccactgaagaatcgcttaatccgctgatagaccagcaattgtttgcgggcacgttgaatccggcgataccgatgaggatttttttggtaaaacccttgatggtaattctcggctggccagaaagtcgtggctggtctaatctctgtgatgattggttttgcataatgacctgccctttgcagctgttcttttgacgcttcagcaatcgcttgttgctgcggatctccgacaaaaatgattggtcggtactgctttccccgatcttgaaactgtccaccagcatctgtgggatccgtcaactgccaatacaatgagactagctcctcatacgtaatcaaccgattgtcaaaaatgatttccactgcttctacatgtccgcttaacccgctactgacttgatcgtacgtgggatgcgggatattcccgccggtatatcctgaaagaacagaagtgatccctattttctgttcaaaaggctccaccatacaccaaaaacaaccccccgcaaaaatggctgtttcttgatgactccagtcagtgatttgatgtgtctttgttttttgagttgtttgagttgtttctatccctcttaactgatcataaaaatcctgaaaatccggtgtcaagttgcctcgaagtgccaatggtcgcaaagcagcttccaactctgataggacatttttttgttcttgtccggattctaaccgatctcgggctgccaacaactgggatcgttcccaatctcttgtccctggattgatgatcaaattgtaaagctgacttaatcgttcctcgtccatccttctcatcctctctgccagcaaaactttgaagtgttccatcctcttgcaattacttgaaatgatttatatgcaaattaccatatttccttcatctggcctactgattcgctttctgaccaaagaaaaaattctctaaatgacaaaaaaaccgaacaaatagcggtacagaccatcaacataggagggtctgaaattcctgtagaacagaaatcagctatcgttcagttcgaggtattttgctgtttggttatcttaagagcattgtttatcttgttagtgaaaaatacaatggacttaattcttctaatgcttcagtcgtcaatctctcaacatcttcgatgctctctgatggaaaccaaagtttgccgatttgaaaactgcgtccttgcagcttttcttcaagttgtctttgtttttgcggctctgagaggtatacagctaatgggcaatgatcttctagttcatgttccacctgtggccaaatataataatcagccaaatttttgtctttgctccattcttcaatctgccagcgtaagtcattataggctgctaaactccctgaacgttggccacttttgtaatgttggaacatgaaatagacttgatattgcttttgattgatcaatgcagctaggcaggcattttgattcggatgtgcctcattccgataagcacaccaaaaatgactgcgcaaattccaaccattcgtccaactctcaactttcggttgaaggtctgctgatacattggttgcgacagtcatttggatatgtttccatttttgccagctcatctgataatcctctttcagccgctgaattgtttctggtgggtagatgtctttgatttgtttaaaggcaaatacctcacgatcgaataaatcaaaatctgccttagcaaattccataatgtcaccttacttttaagctctatttttttagtggtagtaaacagcatctaggaacaatccttgggaaggcactgtctctccggctgcttttcggacttgattcgtaaatatctcatcgatcgccgaaatgtccattgtacccgcaccaatctctaaaatcgtcccggtgatgatccgtaccattttataaagaaagccatctcctttaaagcgaaaacgcagcatatctccttctcttgtgagtgagagttcctcgattgtacgagtagtggattttttggtcttttttaatgcagaaaagccaataaaatcatgagtgccaataaacttctcacaagctgcttgcattttgtcccaatcaagctcttgcggacaatgaaaactctgatgacgttcaaatacggttggaatcggactattccaaacataataactgtattgtttgccggtcgcattgtaacgggcatggaaccgttcagaggcttctgcgacctctttgatgacgatgtcttgaggtaggtagcgattcaggaattgcaacattttttcgggggacaaatcgcttgctgtcttgaaattggctacttgtcctctcgcatgcgtccctgcatctgtacgtccagacccgatgatttcgattttttcatttgtcatttgtgtcaaaatactttcaattttctcttggatcgttcgatcagaatcgcctaaacgttgccaccccagatagcgcttgccatcatattcaatcgtaagtttaatatttctcatttatgttaattgctcctgtcatcaatgatttaccccaaaaaaacgggttcccttgcttatcataagggaacccgtcaccggtgtaaatgctctaaagaagattttagcgatatttcaagaaaacagccaaagattcaaatttctgatgtcattaaaaacttttatttcccaatcactaatctccttgtatagactgcttggcccgaatgcatgactgcatcatcgacgatggagacgatccgagcttgtcgtgtcacagctggcgtccagttctcatcaatcacttctgataagctagtttcatcgatagactgaaggtaattaactgctaactcgacactagcagaaagataatccactaatagttctttttgattaacaattaccttggcggcttcttctggtgtatgacgccaatcttctgtatcgtcaggcaaatccaaagcaaatcgcttcgtccagtccgctagccaaagtggttcttgatccgctaatgcggaaatctgcagatcgatttcgcgagcggtatgccagatcagccaagtgactgacttaatcagtggctccggcatcgtgttcgcttccgcgatactcatttgtgccaacgtttcttcaaatcgttcttgggcccgttgcaatgtctcgatcgtcaattgtgtttccttcatgatactcctcctctttagtaagtgcttatctttactctactacagaaaaagggagaaaccaatgaatcaacctgctggtaaaaaggactgaaaaattattcttccgcataaatttctttggctaaattgaatgccgaccatgctttaggccatccggcatagaaagccaagtgtgtgatcaattcaacgatctctgcttgagtcacaccattttctttggcgattcgtaaatgagcttctaattgaggcacaccttgtgtcaaaaggctggcaacagtgatcaaactgcgatctctggcggacaattcttgttctctagaccacacttctccgaataatacgtcatcattcaatgccgcaaactgaggggcgaagtcacccaatcgttcgcttcctgctgtttgttttttcattctcattgcctccttatttttgtaactgctgatagtcttcctccgccacagcttcgagccattcaggcgttccggcagtaatagccagatgttcaaaccagctatcttttgctgcgccatgccaatgcttgatgccatcatgggtgacgacaatatctcctgctgtcaaaaattgggctggttttccttcttcttgataccagccttcaccaccagtaatcagcaaaatctgataaccatcatgatgaatatgccaattgttgcggcaacctggctcaaaagttacattcccaacgccaacattgaccgaggggtctgcaactaaagtgtttaaataactttgtccaacaaagtattgggcatacgcttcattttttgcgccacttgggaaaatcacgccatcttttacctcttcaaattttgccattgcttgtctcctccttgcatacctctttgtctgataccattgtgccattttgtcagctttcacaatcaataaagcggcaatcctttcaataacttacaagttcatgttactgcttgatccacataacgtccaatacttgttaagctgatttctatgcttgcaaagcatgcttgaatttcttcaaaaatgtttggactgtcggcgccaaaatcgtctctttcctccataccagaacacagttcgtttccagaggtggcgaaaaggggatgaattttatttggttttctcgatgatgaatcgctccagcaattgctaaagcagcaccaacattgttttcgaccaataaaagcacattaaaaatcaaattgtatctcccaacgattgtcaactcttcttcaacgaatcccccccacgtgcaaaacatttccaaaacttctttacgactcgaacaaatcaacggtgtggtgaggatgtctgcaggtgagatactgctttgatcagccaacgggtattcatttgcaacaaacagcccccagacttctttcttaggcaatggtcagccgattgtattgatccgtcgttgcaggatcaatcaaaatcgccacatcaagcaagcctttatcaagtttttccagaatatcattactagttccgctaaaaatagtaaaagacacttgggggtgatcagtaaccatttcttcgatgatttgtgtgagcaaataggagttttctgcttccacacaaccaatcgcaatttgtccattcagaatcgtctcctgataattgaacaattcttgttctgttttctgattcaattcaagaatttcttctgcgcgcttttttaaaaacagacctgcttctgttaaataaagtttcttattttggcgcacaaacaattctgtgtgcaaacgctcttcaaactctcaaatttgtctgcttaaagtgggttgcgtaatgttcagctttttagctgcttgggtaatattttgttcctcagctattgctagaaaatactttaatacacgagtttccatcgaaaactcctttcttctatgacacaacatttttcctactgttatctcagattttcgggaaaagaacgcatccttatttatctgtaacaacgaatactagctttattctaccacctaactagaaattcttgaccgctattcgtttggttcatccaaacaaaaaggcccttcattcactgaagagaacgaaggaaccgatagaattgaatttcagttgtttctaaaggacgtttttattacaagcgaatcggtgtagcagtcttttgcagaacattgtttagcgcttcaatatttgtacgtccttgggtctgcagccactctttcgccgcaccttctccctgagtcacaaaaggctctacaccgtttgcccaggttgctcgtccacaaagtacgccattgaattttgagccggatgttttggcaaattgcagtgtttcttggaacaattcagctgaaacccctgcactcaagaaaatatagggcagatccgttgcttccgcttgctctttgaaataaaccgccgcttcttcttttgtataagcagcttcctccgcatagccctctacatagttcatattcacagggacttccactttcaagacatcaacgccatagtatgcttgcgaaaattctcgcatcatatcatttactttatgaggttttttcaaagcatattctttcgaagtggtatctgggatagcagcatcataagaaaccagttctaagaaaaatggtagattttcagcaaggcattccgaaccaatccgttcgataaatgccttcttttgatcattgatctcgtcaggttcgtccacatcataatagagcaaaaacttacaagcatccgcgccattttcttttagccgtttcacagaccagttggacaaaagatcaggcaaacgacccggagttgaagcatcataaccggttttctcgtaggctaacaataatccagcttgttcatcccgaacttgggctgctggcaatccatactctggatctagtaaaattgctgaggcatagggcgtcaactcggctgacacgatttttttgaaggcactgatttgctctgtcgtgactgaatggtcttggaatctgccaatcatttttttcaaagcccctcgttgatcaatggctaaagcactaataatgccattttcattacatagctgttggatatatgcttgcttatttgataatgtcatgctttcactacttccttttttagttttctgccagttttccatttaaaatttcggcaatttcatcaggagactgtgcttgcttcaaacaatttgtcacctctttatgcatcaaaagccgtgccacttgagacaatagtttcaaatgtgtcgttcccgcttctgaatcaggtataaaaagagcaataataaaatcagttccttccccatccaaacttttccaatcgattttgctatttaattggacgatgatgacattggcttcttcgatactgtgatctttcgcatgagggatagcaaatccatccatcatccccgttgtactctcctcttctcttgttagcaattttctataaacagcagcttgatcactgctgatgcctagaataactgcttgtgctgcaaggaaggtcattatttcgtcttgtgtcacaaaatctcgcttcataaaaatgtggtctgttttgatcaacgtcatttgtcttcctcttttctattctttcgctgtttctttccattcatcagctgaaacttctgcttcacgtttttgtacactgcgtttttggatgaaccctaaaatcactccacctatgatcgagccaagtaaaatcgaacctacccaagcaattttccccgtgacaaccggcaatactaagaagccgccatgaggagcaggaacttggactccaaacatataggtcaaaaccgctgcgatcgatgaacccaacatcatcgtaggcagaacacgcagaggatctttggctgcaaatggaatcgccccttcagtaatatgcgttgatcctaaaataaagttgactagccctgcattgcggtcgttcgtatcaaaatatttcccaaaaaataagacagcaaatcccgtaatcaatggtggcgcgatacatgccgcagaaacacctgccataaaggtatggtttccttgagctaacaatgccgttcccgtaacgtaagcggctttattgacgggaccgcccatatcaaatgtggacatacagccaacaatgatgcctaaaatcaatggattcgaattctggaatcctgccaagaaatccatcataccttgattgatcgcctccatcgggcttgctaacaaagacatcaccacaccaatgactaaaacaccaatcactggatataagaaaatagccttcaatccatctaattgtttcggtaatcctttcatgactttttgcaagaacagaataaagtacccagctaagaatccagcaaagatcccgcctagaaaaccagcgccaccagcattggccaacaggccgccgacaaatcccaccaccaaaccaggtcgtttagcaatcccttcagcaatgtaagccgctaaaatagggaccatcattcccattgctgtatccccaattccttttaacatcgctgatgtcggattataggtgggatcattaggatcaaaagagtagacaccccagattgcgaatgagacggcgatgatcacgccccctgctacgacaaatggcagcatatgagaaacaccattcatcagatttttataaatactatgtccgattccggcagccattcccccatctgcttgctccaatgcatcgaccgtcttgttttctgcaatcagcgaccctctcaatgcttcttcaattagctgatcggcatctttgattcctttgctgaccggaacattgatcacgcgttttcccgcaaaacgttccgcttggacatctttatctgcagcaataatgaccgcatctgcattttttatctcttctggcgttaactggttttctatccccacttgtccatgagtctctactttaatagctattcctttgcgtttggcggcttgttccaacgcttcttgtgccatataggtatgggcgatcccagtgggacagcccgttgcagcaacaatcttgtaagtggtcattttttattcgctccttcttttgatttcaatttgttcttccaactctgcaacatccgaaaaatcagttagtcccttacgaaaagcggttgaacttccagcagctaatcctttcttcaaattgacatccagcggctcacctgttaaataccctgcaagaaatgttcctaacaacgtgtctccagcacatgctgtattcactactttgcctttaggagagtttccagagtagaccgtatcttttgtcaagagaaggccgccttctcctcctaaagagagcagcacatgttgcgcaccactagccaccaatcgtttggcgtagtcgatatagcctttgcgatcattgatttcggtctgataccatgcttgcagctcttcttcattgggctttaacaagaaaggctgataaggcagacattccaacacctctgaatagcttgaatcaataatcagattcacttgcttttcaaagcaaatacgactgattgctataagaattttgggcgagacaccttgtggcatactcccagatatacagagatagtcaccagcttgcagatgtctaatttgttctagcaaaagattgatctgcttttttgaaatttcaggtcccttattcacaagtttgtactccttattatcgcgatttacatgcgtaaaaacgttgattcgcgtaaatcccggaacgggaataaaatcggtctgaatcgcttgttgatgcaagtagtcctcaatataattaccagtaaaaccagctttgaaccctaatgctgtactatcgataccaagttttttcatgatcaatgagacattgaccccttttccattggcttggatatcatcatcctttgtgcgattcacttgaaatggtttcatctcatctgtttcgataaaaagatcgatcgctagatttaacgtacatgtataaacagccatttgcgcccctcctttcctacaaacctattatggatcactacttgatgtaaatgttttcataaataaacaaaaccgctgaaaacttttacaagaaatacttcatgaccttgaagtaggtgaatctttcgatttacaataaagactagctgaagggaggcagaacatggatacaaaattaagtgagtcagagcaatacctgtgggattttatccaaagtcatatccttgagattccgtcttgctccattataaaattaagtgaatatgcaaacgtttcaacggcgactgttgttcgtaccatgaagaaaaaaggatacgaggggtttactgctttcaagcattcactaaaagaaaaagataataccaatatcaattttgcagcgcttgataaggtggacgaagggataaagacggcgattctaaagaatgaacaagaagtgatccgcacgatcaatatggtggaaagcggcaatatcgaagacgcgatccaacgaatcaaagctgctagacgaatcatgatttttgctcgtggattttctgaactgattgctcaagaaatgatggtcaaatttcagcttactggcaaatactgtgagatgcataccgatcccaacatcattaagaacatcagtaagaaactatcaaaggaagatatcgtgatcttcgtttctttaaatggtgaaaccaaagaattgatcaccgcagctgaaaactgttatgaagcggagatcggtaccattctgctgacagccaatcggcactctagcttaatggcgcatatcgaaattccttttgttggcttcaaatcagaaggctccttctttccagactatgaagttcgttcaagactgcccctctcgatccttgctagaatcttgctcgacgcgtatgcgctgcggactgcagaatcaaagaggcactgatatcttgagaaaatcataaccggtaaggaaactgtagttgatttgagatttttcaaaatgaaatgattcacgctgaacgcattgtttttgcagttattcatatagaattcgatactcgtcaaacgatggggttctttgatttttatccagttaaatttgcttatatttttttgtcaaaaaatgatcatccgaaaaaaatctttcgatttgataaagcggttcgtaaccgtctatctgatcgaaagatttttttgaactgtttgcgtatagaaatgcttcctttatttcgcctcctgattatcgtcggtacgaaacgtcaggcattaggagtcagcaactttactggataacttaactcgaataactaaaacctaaaacttagtagaatgtttcatcgtatgcatgcatttaacccaacaactacgactatcaccagcccgctcttgcttaatccaaatcaattggttgaataaaatcaacctgccatttcccctctttctcagaatagttaaaataccatagttgagaaaaagattgttttcgatgtttctttcctgagaggatctgcttactcacccggtcttccacataatcatagcagctaaaatcaatccgaatggaaaagctatcttcacgtagttgtcgataattctctacttgatgtaggatgactttctttgtatgattttttataccatcctctttattctgttgcaatacttgactgtgttccaacaatagtttgtcagtatagtgtctgctggatttttcaagtgcttcttgatcccaagcggtttggatcgcaaaaaagctcttttggatttcatgaagtaattttttcttttcgttctttttacctgggatttgagcgaataaatcattccttctggttcgttggtctttttttcgtttaactaaagagagaatcgcggctccgcctactgacgccccaaccaaaacataattttctataactgatgatgaaccataggggctataatatccataccctcgtcttccccaagaagctctggaataatgatccgaatagtcatcaactgttgtgacaccgccaaagccgccacgactggtcgaaccaccgccgtgtcccccagcaactgccattccctgcactggcagagcaaataaaaagaataaactaagtaaaaaagccataaagtagtgtttcttcattggataccctcttttgtctgactcagaaagcccgacaattttttcaaaatctttttcatgccattcagttccaagtgttcttcatcttagcactgtttaacgattggcaagctgaataaatgcattttttaatgattcattcgctgtctctttaaaatacagataattgttttgatttccttgattttgttgtgtgattagaacttttggctgcttttgctggaagccaaagaaatagagatgccctccagctggtgtagcatggtcgatgtccgaatagattgccacaatctgaaaatcggcttgtccctcaccattttctgaccactccaccgagacgggcgtttgattaatgacggttgtccatttaccaccaaaaatatcttgaggtacttggagaccatagtaattcgcttgcacatggtcgtcatagcttcgatattgctgccccatttcttgtccccaactctgcataaacgtcgcaagctctgcagacttggaagcatcccacaaaacgtgtgtcaccggttgacttgcttgtgcagtattcgtggaagcttgtggttgtgcgctttgctcatttgacgattgttgttcagatgattcagtggtcctgcttttagacgcttcggtactcgtagcgttagctgttttggttgaaattgattgagacgtgcttgactccgttgtcacgactttttctgtagaagatgtttcctctgttttatttgcggaacagccagccaaaaaaagcagtagacccatcgttgttactagcattttttttcatttattaaaccacccttaaggagtattcagtgtacatatagtagcagaccatatactaaatgcttactaaatttttgcgaagttttctcacaacttcctcatacatgagattgataaataacattacatggcattggtatggatttagaactgcgaaggttacttttaggaccataaaaataaaaaaacagtttagtgtagttgttttgaaaacattgaatcctttgcgcttttcttcgcaagtttgcttaaatatttcaactaatgacaaaatgctcgtttgttccctaagagttgcggttcgccttttttgatgcctttggtcgactagctatttttcccagctttgcaataaaatagtccaaccatcgaatcaagatgattggaccttttgacgcaagttgcctttccaaacaactttgctctcaattttttttgatgtttaatccttaattattttctttaaccaaagaagctccattagtcgcaatcacctgtttgtaccagtaaaagctatcctttttaaaccgatcataggttccgttcccttcatcatccgcatccacatagataaatccatatcgttttgacatttgagaagtcgatgcacttactaagtcaatacatccccacgtagtataacccattacttcaacgccttttctgatggcttcattgaccgctttaaaatggtcttcaaaatactttatgcgataatcatcatgcacttttccatcttcaaacgcatcaaaagcaccaatcccgctctcaacaatgaacagaggcattctataacgatcgtacatgtcgattaatgcaattttcaatcctgttggatctacttgccaaccccaatcacttgtatcaagataaggattcttcacactggtgactaaatttccgccaactttttcccgatcttcttcatcttctgttttaatcatagacatataataactaaaagagacaaaatccactgtgtgttgctgaatgatctcctcatccccttccaccatttcaatggaaaaattgttctcttgccagtaatttttgacaaaagtcggatacgttccaaaaacctgcacatcagaaaaaaagtagttctcccgattatgttgttgggctagcatcacgtccactggatttgaggttaacggataagctaaagctcttgtaaccatgcaccccacctgcgcattaggaatgatttgatgggcatatttagtcgctagggaactagctacaaactgatgatgtagcgcttgataaatggcctcttcagcttctttttttgttttgtacttttcttccaccactcccatcgtagtgaaggggtgtctaaagacgctatcgatttcattgaaagtcagccaatagtttacatactttccgaaatgttcaaagcaagttttgctaaatcgtacaaacatgtcgatcacttctcgggaaacccagccgtcatattcattgactaaatataatggcatttcataatgagacaatgtgactagaggttcaatcccattcttcttcatctctttaaatatgcttacgtaaaaatcgattccagcttgattgggttcactttcaatcccattggggtataatcttgtccatgcaatagatacccttaagcatttcagtcccatttctttaattaatgccaggtcttctttgtaacgatgataaaaatcgattcctcgtcttttcggaaataacttatcgttttttgactgcatggcttcctcgatttgttcaggagacacgtgccattgactgatataatctgtcctatctacatcaggtttgtacattgcgacatctgctaacgacatcccttttccatcaacgttccaagccccttctacttgattcgccgcaattgctccgccccaaagaaagttcttgggaaaatagcttttattcattcgattacctctttcagattgttgtttttatgctattatttctgtttgtatcgtttttttgccagtgaaagtttggatgattttacccttagagtcgataatgtctacctcatcaagatcatccaaattggttactacaaggatcgtggttggatcatagccttcagactggatgccttcaatatccacacttccgattctttgccccttttggatgtcatcgcctgctttaacagctaaatcaaaatagttgccgtttaattcaacggtattgatgccaatatgaatcaatacttctacaccagatgttgactttaatccaatcgcatgttttgtaggaaaaaccagttcgacctttccactaaatggtgctttaattacgccatcagttggtattgcagcaaatccgtcacccatcgttttttctgaaaacactggatcgttgactttttctaactcaatcacttccccatccaatggtaaactgattgtattgacttgaccttctgtttcttcattacttgatgaagattcttctcccagtccaaaagcaaaagttaaaattgctgacaggaagaaagcaagagcgattccgatgaggtaataaacaaaggtatcacccaaaaaggctggtaacgttgttaatgctggaaaaacatagacaatcgcctttgtctgcattgctcccatgaaagctccagcaattccacctgcgattgtttgggcaatcaatggttttttatattttaccgacaagccatagacgatgggttcagttatcccaccaagtaaagctggtacaatcgcagatagcgagagcactttaaacatttttatctttgcttcttaaaaatacgcctaacgccacacctgcacttgcaaaagtggcagccgcaaccattggtcgaataacgtcataaccatagactgcaagattattgatcatgattggcacaacaccccaatgaatgccaatcattaccaagaaagtccatcctgccccaataatcaaaccagccagtaacccactgcggtcactgataaagttcatagcgcttccaatcccatcccctaatgtaacgccgattggtccaacaactaacacagttagcggaaccataataagaagggcaaccattggcaacaaaaaaatttctaaactctttggaatcattcgctttagcagcgtttctaactttgaatagaggtaaatggaaataatcgcaggaatgacagttccagaataccctattaaaattgctggaatacctaagaaatcaaccgtcacaccattttctgtgactaatgctgtgaaattaggctctaaaagtgctgctacaattgctaatgaaataaattgatttgttctaaacactctggccgcactaaaagccaaaaataacggtaagaagaaaaatacactattgccggctgctgaaagaatcttataggtacttccatctgctgacataaaatgataggtcgttaaaaccactaacaaggctttaatcattcctgccccagctaaaggcataataatcggattaaaaatggaagacagtgtattaaagaagcggatgaagatatttccagatcggtcatcatctaatgcttccgactcgtctgatcccaaggcgcttttaatgtcatagttagccatgatcgttttatagacatcttccacttcatttccaataacgacttggtactgattatttgcttcgacgacggacaagacaccggaaatcttcttaatttcatcggtatttttttgtgcaatactttcatcttttaacttgaatctcaatctagtgatacagtgataaagactaatgatattctctgttccaccaacataatcaataatacttttggaaagagcactataatttttccccattgttacaactcctatcaattttgtttatgtttgttataatacatgtgtaatatacaattttttcaacatattaaataaaaatttcgttttttggaaactctttcacagataggagctagtatttatgggacccttaattattagactattgactgttcttaacaatgaaacaacttcttctacctactaccatatcgctcagacacttttgaataactatagcattatcgataaatcaagtatctctgatatagctactttatgcactgtctctaaatcaaccatttcaaaatttgctcgttccatcggatttgaagattattatgaattaaaaaaatcctcaacctttgctgaaaataaataccatttcgacttaaattacatttcaaatattatcaatccaattgaaaaaaatggttatgatgattatttagatgccatcattaaagatattagtgcgttcaaacagcaaagcaacatgagaagtattgatgagttagcaaaatgtctgactacctataataaagtaggtgcttttggactgctattttccgaatcagcagccattgattttcaatacaaattggcttatgcgggaaagtttattattacttatcaaagtgatctcaaacaaatcgaattcatagaacaagccgatgaagagacactattgattattttttctaactctggcggttttttacagcgacaacaacttagagatgatataccctacagaaatgtatttgaaaacacaaaagccaagattttcgtaatcacagcaaatgaagaggttcgtaactatcgtttcgttcatgatgttattcttttccctcatgagactatttttcaaacccattcttttatctatcaaatcattatggatatcatcgttagtaaatatcgacagtatcttgaacctccaacaatctctcacaaacaataataacctacgaatgaaattgacaaaagaactgctagtgatgagaaacctatcactagcagttctttttgaggttttattttttaattaggaagaagtagtcatctaccattattagcaaatatgccggcaatacttttccaatgtatttcttctcaattgcaacttccatctaactattgtctataaggttttctttcttagaaaaatcaattatcagcatttttgttatttaagttatcccgtcatatcattttagtgttgggcttttcttgaaacacttttctaatgattaatatatgcaattgcacttccactaccaaatttaatctccggcaacgatcgtttgtataaattcagctctcttaacgtatcatctctttgagagagtgcacgaaacgcatagcgtgtccgtccgttttcgtttttcttcgatcctgaatattgagaggagactttatatgcagcaacaaccgcattatctgctccagtattaatcgctataatgtagcgaatccgatgaattttatcacgaccaattacccaattacctagcgtacgagattttaaattatgatcatcacgaaatttgtcgtcaatcggatattcatctgactcatctttacaaagttcaaaagcatctctcacttttactgctaagaccaactcatccgttgctatttgatttacagatatgggttgaaatccatatcgctcttctacctcttccactagcattggcttagaaccatgtccttttactaaattcgtcaaagagagtccttgaatcagttgagcataattaatcaacgcattttcactagcgtaagcttcattctcagttaatccatagctaagtatataactcaatggttgcagattcattccgtttatttcttggatagtttttatttttaatgttctagctgattcatcttcttcaaaataatcagattgacttaacatacttagagccgcttgacgatgtgcaaaaatacggttacctttgcctttcccaatataaaaagtctggttgtttctaggatcaaccaaacaataaacatagtaaggatgttgctcatctttttgcaacgcagctaaagtagatgcagaaaaatggttaagttcactcatttgttactcctctgttttactattttttctttcgtggagaaaacaccctcacttatgataaggcgcgcctgtattgatgcgaaaagcacgatagatttgttcgactagaatcagtttcatcaactgatggggataggtcattttgccgaaagagatttgggtgttgctgcgctgcatcacttcttggctgagacctaaggagccgccgattacgaagactagttggcttttgctttggattcctaattgctcgatctgctgggcaaaagcttcactggtgggatttttgccttcaatcgctaatgcaaagacgtattcctggtctttgatctttgccaagattttcttaccttctttttctttcacttgaagcatttcagcttcactcatactttctggagctttttcatcaggaacttccacgaattggattttacaataagcgcctaatcgtttcacgtattcattgatgccttgaatcagatatttctcttttaatttgcctactgtgacgattttaatattcatgaccactcaccttccgctatcattataatggaatttcttttcagaatatatgtcgcgtaccaattttttcttctatagtaccattgataccacgaatcgtttcaagtgactcttttcttactaaaaaaatgattggtagtctaaaaaaagaaatttcattgttttggtctaaatcctccctatcttcttcatatttttttcaaaatctcttagtagactattgtcagaaagaaagaatataataaatacatacaaacaattcaatagggggaataacaaatggtacgaaaaaatgtgacaccaggaagaaaaccttcttccggcttattaaaaaaattaggtattggcattcttggcggagtagttggtggtttgttgaccttcggcggactttatctggcgatgggctcttctttgacttcacctgtaacgaccgcaaccagcggtgttcaagataacaatggacaaacgaaagtctccaatgttaaatatgacgtcaacagcgatgtaacaaaagcagtcgaaaaagtgcaaggagcagtcgtttcgatcatcaacttgcaacaaaataatgcgaatggcctcgaagggttatttggctctggtcagcaaggtggtcaagaatcagggactgagaattcaggcgatgacagttcactagaagcttcttctgaaggaagtggcgtgatttataaagtagatggtgacaaagcgtatatcgttacgaataaccacgtagtagaaggacaagatggtttggaagtcgttctctctgatggcacaaaagtcaaagctgaattagtcggaacagacgcttacactgaccttgctgttttacgcatctcttctgataaagtagacacggttgcttctttcggcgattctgattcactaaaagttggcgaaccagcaattgcgattggttctccattaggatctagctttgcaaattctgtaacgcaagggattgtttcttctctgaatcgtcaagtaacgaatcaaaatgaatctggtgaagcagtcagcatcaatgcgattcaaacagatgcagcgatcaacccaggaaactctggtggtccactgatcaacgttgaaggacaagtgatcggaatcaactctagcaagatcgccagcacttctgaatcaacatcaagtgtcagcgtagaaggaatgggcttcgcgatcccaagtaacgacgttgtcgatattatcaaccaattagaaaaagacggcaaagttgttcgtccagcattgggtattcgaacaatcaacttaagctcaatcacttcgcaacaacaagaacaaatcttgaaagtaccatcttctgtcactgacggagtagtcgtatactcagtaaataacgcgacaccagctgaacaagcaggattgaaacaatacgatgtcatcacgaaaatcgatgataccgacatcagcacaaccacagatctacaatctgcactgtacaagcacaaagtcggtgatacgatcacagtgacgttctaccgcggcaaagaagaaaaaacagccaaagtcgttctatctgtagatacttcgatcaatgaacaatcgactgacagcagcaactaaattcaagtcaaaaaaagatctgccacacaaacaggacgtggcagatcttttttattattttccaactggaaaagcttcaccaacaacggcatcttgtggtaattcaagaattccttttttcaatggtgcatttgctaagtgcagttcacgagcagaacagatcatgccgtagctatcgacgccacgaagcgttcctggccagatcaataacccatccggcatcattgcccctggtttagcaacaacgactttcaatcctttgcgaatattggcagcaccacaaacgatttgcaggacctcgccttctccgacttctgtttccgttacaaataaatgatcactatctggatgtggttcacatgttttgacataacccacaacgattttcggctctaaatcaattgccaattgctccgtaaagccagcttctgtgatcaatcggttcaaagtttccacttgttgtttcgtcaaaactacttgtccgtttccttcaatggcaactgtatcagaaatgtgaaagaagttccaacctacgatcgtaccttcttcatttttgatttgagcgacatttccttttcgtacagccgtttgttcaagccctttatcatctgctgtgatcacgatcaaagtatcgcccacatattctttgttgtatgaaaaaatcacttgtcttcctcctcttacttattccgcccataatcttaacaaatttttgtctgttcgtcatgggaattttctcagtttacaatcgctgcacttcccaatccataaaaaaactgcgacagaaatcagaccaacaggcagctagtgaatgaaaaagcactcgcttgctcttttttcctgtctctgtatcttctgtcacagctttgtcttttgcttattcttcgctaggagagacaaccaacacatcacatttcgcttcgcgaataatataactcgctacactcccggtgataaatcgctcaactgcattcagtccggattggcctaccatgatcaaatcaatcccatatttttctggtaactgtttggccattgcttctttcgcagagccgtaagcaatgatcccttcgatcaaatcaaaattaacggatttaccatattgtttacaggattcgattaattcttgggcagtatccttttcctgctcaatgatcgttgtatctaaaggagcatatcccatcatcgtggggatctgctgatcgatgatattcgctacatagactttcccctgattgcgtcgtgccacttcaactgcttttttgaacgcttcattggcttggtcggagccatcgacacctactaaaatattttgatatctttgcccactcatgtttttcacctcgaaagtttaatttagacttgataagaaagattcgatttctgcttttgtttttcgatctttgttgactaaacgaccaagttctttgccgtcttcgatcactacaagacttggaattccaaagatattccattccacagccacatccatataagcatcacgatcaacttcaacaaattgaaattcagggaaatctgcttcgatctccggcaattgcggtttaatataacggcaatccccacaccagtctgctgtaaaaaagaagacattctttcctttttcgacatatgttgccaattcttctaaattttttggaacaatcacacgctcaccactttcttttctctaatcaaattatacaccttttaaaacagggaaccaactcacaagcaaaagagctgtgaacacgcccatgctagtcactgaaaacagcaccctagttgtcccatttcctgattatcgtaaacagttacaataacagatcaaaaattgaaccaaataggtctgatctagcgttgagtcgtatcacagctcttaatttttattttccttctacaattgtagcaactgttgatttatccaaacctttcaagacttggatcaccatttctctcgcagcatcaaagtcagcgatgctgaatagtgtttgatgggtatggatataacgtcctggtacaccaatcacagaacttggaattccttcattggccatatgagctgcaccagcatccgtaccgcctttagacacaaagtattggtaagggatattgtttgtttctgctgtgtccagcaagaattctttcatccgaggcaacatgatcattcctggatcatagatacgcatcagtgtaccttcacctaaatgcccaaaagtcccattcttcgtcactgtatcatcagctggtgaacagtcaacagcgaagaatagatctggttggaatttcgtgacagaaggttttgaaccacgtaagccaacttcttcttgcacattggcaccagcaatcaatgtatgacccagttgttcttctttcaatgcttccaatgcttctaatacaaccgtacagccataacgattatcccaagcttttgaaataatgtttttgccattcgctgtcttgattgtttctacttgaggtacgatggtgtcacctggtcgtacgccaaaactttccgcttcttctttagaatcaaaaccagcatcgaacagaatgtccgttacttctactgctttttgtccagctgttccacgtagtaaatgtgggggcactgatgaagaaatacatggatagttgcctttcgcagtttttaaagtgaagcgttgtgctgaaacgacataagggttccaaccgccaagaggtgtcactttaaataacccgcgttcggtgatttgtgtcaacatgaatccaacttcgtccatatgagcagctagcatcacgcgtggtgcatctgcatctgaatgatgacgtaatccgaagatcccgccaagtccatcttgttggatttcgtccactaatggagtcatcgcttcccgcatataggcccgaacatcctgttcaaatccactagttccttgcaattctgttaattctttgattcgttgaaacgttttttcttccatacttttttcggcttgaatcgaaacaagccttccctcctcttgcaaatctatatttattataacgcaaattactcattctggttcttttcttatagaaaaattctaaactatggtaaaataatctaaacagacaaaaggatttccgtttattccttaacaggataggagaagtcttcaaggaggcacaacatttatgatcaatgaacgtccattcaattattttaaaaacggcctggccatcggcgtgggtgtcggttttgcaggcgggatcttctcgacattatggatgaagaaaaaacaatcgatgaatgcagatgacgtcctcgatcaaatcaaagcagcatttttaaaagaaggtccgatcgaaggttcctggatcaattttgagaagcaaccccttcgtaaatttgcagtgacatctcaaggatataccggcggtattactcggaccgaagacggacaactgatcacttacgaatttttagcagatgcgaaaacaggaactgttttggatattcaacgatcgatcattgattaatacgcattgctatacaacagacgctcaatgattcaaactcataaaatagtcgaacatcgctagatgatttttcttgtcgttctttatgaacaacagtgatcatcttgagttgtccgactattttttagttgcagcaatctttttgggacgtttatttgcatgaagcaacgttgctaagtctagtaataaaacattggctaacacaggattggctttctcgcgatacgctgcggcgccactttcaaacaatactgctagacgatcttctaaaacaacgatttgttccaaatacggtggaaatttgattcgttttaggatccggctaggagagtcccgctcggacactaagagttccgaggtataaggaccataagaacgactggctaagagataatggccataaaaagccacaccttgaatcttatcagatgtttttctgctcattgtcacggttggttggattttgtctttgcggcgaattgctgttttcatttcagctatcgtcggcaatagatagaaagtcaactgtccttcaccttttagtgtgaagttgccagataccagttgatcattgttttgagtcaaatacgatgcttgtggaatctctaagagatcagttgtcagccaataagcgattggctgtcccgtctcttcagatgtatctgctaagatatcgatcaaacgtaaagcggctactcgtccagtagcagatcctgtgattgtcaaccataaaagttcccgttttgtatcatatactaagccccctacatgtggccgtttaggtaaaatcagcagtttgatcggctgtcctgtttctctatccagtacatgaataatagaatgatgctgatggtcatagcagtaggcagaaataaacacaaaatcttgagaaaaagccaacccttgcggcgtcatccattgacaaacctcattttcgccggtttccggcaccaccattcttgtttctgttaatccaggaatgttatattgttttgcttcagccttttcccaagctgcttgaacaataggataccgttttaactttttttcaatatcctgatgtatccgttgctgcttccaatgcttaaactttaggacatagtaaacaaggaggccaatgaccagcaacactaaaatcattattgctacccgctgagtcatttgtttgcctccttgttctattcgatcaatcgtacatataccgctattaattacagtatctacatgtttcttttactagcgtttctttataggatctttcataatctcatttatagtaacattaagaatcccttattctactatagtcacttccacatcaatattgcctcttgttgctttagagtatgggcaaaatgcgtgggcttcttctgcgattttctctgcttggtccttctcaagtcctggcaaagaaacttctaaaacaaccccgatttggtagcccccatcttctaattgaaataaagatacccgtgctttgacttcagaatcagactcaagattattttcttccagcatgtgttgaaccgcgccgttgaagcaagatgcgtatccagccgcaaatagttgctccggatttgtcccttcactatggattcctgggcggtcgatcttcatgtgcatacttccgtttggtgcctcgacctcgccatcacggcctccacgattgatcattgctgtttcgtacatttttttcattgagatcatcctttctttcgtctttctatattaagtgtaacgagtattttttaatctgacaaaggtaatgcttgcattcgacgacatcagttagacaacatcgatgatcagtgatagaagcagtttgtctatacaaaaaaagaagcagcgaaaagctgctccttaagataataggtaaaattgctgatatatttgacgattaacctcttgaacgtcccaagaaaaatgatactacagcaacaacgatgatcgcaccaatgatagaaggaatcaaagccattcctgctaattgaggaccccagctacctaacaatgcttgtccaattgctgaaccaactaaacctgcaacgatgttagcgatccatcccattgatccacctttatttgtaattgctccggcaatcaaaccgataatagctcctacgattaatacccataaccaatgcataattttctccttctttctgtgaaatatttattacacatattatgttacgcttcttcttaaaaatacacaaaaattttgctcttaaaaaaacaaaaaaaatttaaaacgttgttatattaaggataaatcaacttttttggaatcgttaacactcactgcaagaggtcaaaaaaactgccgcagctctttgaaatcgttttgatcagcaaaaagttattttctgataaagggtacctagactatgtacgattttctttcattgtctgctttcaaccgtcatcttccctatgaataaaagcaatcaaagaaaccagattgtcgtacacacctcattcactacatccttctgatgaaacatcaaaacaattggcattcctttgattctgccttttgtatttgaaacctgcttcccctcactatgtaaaaggattatgagaaaaagcagcgatagaagtgagcgtatgcaatagcgagtaaagtaaaaaataaattgttcggattgtaccccggcctttcttcttaatatttttcatttctcgcttctcccctctgcttattggacagtcttcgcgattgtgaagtcacgaaaaaaagcaactttgcccagcgttcaatgctagacaaagttgcttttttattttgtttttgaaaagtctttctttgaaagatagacagcagtaaggatgcctactaagacagctaacccaaagactagaatcgttcctatcgtgttatccttcccaggcagtccgccagtgttgatcccccaaagtccagcaattaatgatggcactgcaaccactaatgctgctgaatctaaatatttcatcaaatggttcaaattattgtccatcatatccgagaatagaccaccgatggtttccaataaatcgcgatagatcgtgacaagcttgttggcaaatttctgtcgcagtttaatgtcgtaaactaacgattcattatctagtttgtctaaaaactcttttcgttccatcaagtgattcactgtaagattctgatctttcaatgtgtgatccaaataaaccatatctcgttctgtgtctgccagattaaatagttcattattttcggttgttttacgggcagccgcatccaattggtcgatttgctttttaatctctttcaacccattgataaagtgggtatagatcattaatgtggcaaaagcaatgatatcctcaaaatgtcgaagctcatttccatgtttctcgatcaatcgctcaacgagattcgattctctagagacataggtgatcatcaatcctttggaaagaataaatgtgacaggttcaaggcgtttttcaatgcgttcttgatgatttgaagaaagatcgatcaatgtataaagaaacggattgtttaatttagtgtctcgtaaatgttctaatcgagaaacttcctctggttcatcggagccaataaaaatatcttccggtaaatcaaaaagtgtcagcagctcttttttttcttcttcatttccatgtttgactaccaaccaattatagtcttcttcggatgattctctgatttggttctgttcgattttatagtacgaatacattttgcctctctcctttaactccttcacttctcttcaactatctaatggcgactgctttttgtcaagaaaaagcgctatttcaacggtttttattaatacggaaataaagcaagcgtttgattagaccattctaaataaacgtgagagaatatttttgggcccaataaaaatcattttagaggaggacaactatatttctacatcagaaagaactacagttcgaagcaaaaccagacaaaccaaatccattaattgcgaagtatcttcaagaattgatcggtggccagtatggcgaaatgagtgtagcaatgcagtatctcttccaaggttggagctgccgtggagaagaaaagtacaaagatatgttgatggacattgcgacagaagaaattggacacgttgaaatgcttgctacaatggttgctcgtttattagaaggtgcaccggtagaagatcaagaagccgcaatgaaaaaagacccagcaattggcgcaattatctctggaatgaatccacaacatgcgatcgttgctggcttaggaccacgtccagctgacagtgtcggtaatccatggagtggcgcttacatcattgccagcggtaatttactggcagacttccgtgccaatttaaatgcagaatcacaaggacgattacaagtcgctcgaatctatgaaatgattgatgaccgtggagttaaagacctcttatccgtgctattagctcgggacagctatcaccaaaacctttgggcacaagctgtcaaagaacttgaagaaaaagagggtacaatcttagtaccgagcactttccctcgtaatgaagaacggttagacatcgcctatgacttttacaatttctctgaaggagatcaaagtaaagaaggctcttgggcaaaaggaaaagcacttgatggcgaaggtgaataccaatggctttctacacctaaagttgaaggcaaagcgccaaaactagatcctgtcacaccaaaaatgtatggcacgccacctgaaaaataaattgatcgaaacgaataaaaagagcaatgattccattcacaagaaatcattgctcttttcttgtcttattgagcaagttggttaccttaaagctaaaaaagcgttagagtagaatgtataagaaaaaggaggaatcattatatgaaagcacctttacttacactaaatgacggcaatatgcgcccagccgtgggcatcggtacctatcaaattcgcggtggcgaaggcttaagccagttgcaagcagcgattgcagatggctatcgtttgattgattcgtcaacgaactatgacaatgaaggaatcgtcggtaaagcgattcgccgatccggtgtccctcgttctgagttttatatcacctcaaaattaccaggaaaatatcatggatatgatgatgcactgaccagtattcaagaatcgctggcgcgcatgggattagattactttgacgcctttttgatccactggccactgcctaaacgcggcaagtacattgaagcgtggcaggcgttagtgactgcgcaaaaattaggtttgattcgttctattggtgtatctaactttgaacctgaacatttagatgccattattgaggcaactggtgtcactccagccatcaatcaaatcgagatccatccttactgggtccaagaacaaatggtagcagaaaacagaaaacgtgggatcattactgaagcatggagtccattaggccgcggcagcgcggcgctcaaagaatccatcatcactgatctaacaaataaatatcaaaaatctgcgggtcaagtcatcttacgctggcacgtcgatcgcgggattctaccactaccaaaatcccgaaacctgagccatcagcgagaaaacttagctatttttgactttgaactgactgaagaagaaatcaatgcaatcaatcgcttgaacaaagaagatggacgtattgaaggtcaagatccgaatgaatatgaagaatttgagtaaagtgagacagcacaaagctcctgagggatttcataggctcacatcaattataggaattggaatggtcacaaaaaaagaactgcgagatgacttgccccaattgaattccttagatctactagcagcaaggctctactgaagtcttgctgctattttatgagaagtaaaaacttctgacacgatcagttttcatttggattatgcttttctcacagttctttttctgagttaaaacttctgtacaatcagcgttacaactgataatgaatggcttctttgtattgttcaaacaatgattggttcaattcatcgccgccatccatatttgcggaataaaagatgggcggataatcgattcctgcttgtttcaattgttggcaaacttcgacgataatggtattaaggatcgtagcgccaatcaccgttgaagtaggccccactttttgatccatccccttaatctgacaacctgcatcaccaatttctccatgattatcgattacaagatcagcgacttcaaacagacgaaggcccgaagaatggcggctagtgactgattgcgaatacgttttgtttgttaaagcgataattttgacgcctttttcttttgccgctagtgctaaatcgattatgacaggattacgacctgaaactgagtgtaaaatcagcacgtctccttctttgaacggctggatttccgctaatgcggtgccgtagccttctagtcgttccattttgctagtaaaggtgatgggactgcgatccaacatcagttctcgtccaaagatcgcattgatcgtcatcatccctcccgcgcgatagtacatttcttctgccaagatccccgcatgactagccccaaaaatataaattgaatgcttttctagatttgctgtagtcaagagacgaattgcctcatcgattgcatgctgttcctttttttcaacggtttctagtaatgcatgaattttatcaacatattgatacatattaaattcccccaaatagactgccgagaccacgaccaatgattccccaaagtgataagtcattgccaccaaagatcagaatccagttttgaatcgttgtgctgaatagaacggcagatacaccaactaacaagaccatcacaaatgatgcggcaatggtaccaatgactgcgccacgcaagccgccttgtccttctccaataactgctgcgccgccacattcaaagaaactggtgataactaatggtacgatcaagattccaaaaacattcgtcgtattgacaatgatcacaaggatcgttgaggtgatcatagctacgataaaaccaataatcacggcattcggacgataattgaataggatcggtacatcaaaagctggtttggctccagggacgactttttcagcaatcccttggaaagctggaataatttggttgatcaataggcggaccccataaagcatgatcaagagtcctgcgccaaagttcaagcctgcttgaacagcaaacatgaccagattcccaccttctgggacaagaactggtgcgataattcctacaacaatattcatcaaaaacatcaccaaggcacctgtaatggaaatctcacggaaaaaggacaggttttctggcacttttaaatcttctgtcgatttttctttgtttcctactcgttttgccacgaagccggacaccatcgataagatccctgtaggatgtccaatcaagaacgaatcatcgccagtggcatcccaaacatatttccgcatgatccaaggcataaatgaccaataacaagcagataaaacagctcctaaaatcaataatggaatccccgacattccaccttcaaccccaccagcaacgatcacaaatgggaaccaccataacatatgacccgtcaagaaaatcgttttaactggtgtaaaacgagcaatcaataagtgcaagatcaatccaaaaaacatagctaacccaacagttcccccgtattctgctgtgaaggtcacatcagaaagaccatcggctacttgaacccccaactgtgtctgaaccgctgtgttgattggtgcgatcgttcccgtcagcatattgacccctgcggtcaatgctaccatcccaaaggctgctgtcaacgagcctttcaccacttcggcaaaaggttttcgttgcacgatcaacccgatcattgcaatcagtccgagcaatactggcggattctttaaaatatgatctgtgacaaaactcatgattatccctctctttcagctaaaaacttttccatttgcattttgacttcagcgacatccatatattttttgatgggatagacaggtgctttgacggaagcttgcaaatcattcaataattcgtggcttgtaaaataaacatctgcaggagttgcttttgcagtagacaaatccgtattctcagcagtcgccttcagccccagctccttaatcaccttatcgatcgtcatctttaacaccattgaacttccaacaccaaatccacacacagctaaaattttcatcttcttttcctcctattggaataattggcaaatctgttctttgtcaccattcaaaataagttgatacttttcctgatccataaacacttccatgatttcctgcaaactttccaaatgactttgattgtcttttgcagctaaaacaaggaaaatacggaccgacttgccagctaaatcgatttcgtttttagtcactagcaaactcatcccttgatgaaagacaccttcccccggacgagcatgcatcaatgcaaagtaatcagccaataccatatacgggccattctcctcaacgctatggatcatattagcgacatattgttgatcgatggctttttcatttaatagcggctgactcgccaattgaactgcttcttgccaagtgaggatttgattcgtggtctcgatatgatcctcaggcagtaatttttttaaattgatcatgattttacctccaacatttttgaaatgaaccattctttgtcttcgatcccttgcatgatcaacttcatgacaggttctacttcttgggcctcatcttctcgtatcattagtaacacgatgatatcgactttttggttgccccaatcaacaggacgatccaaaatcaatacagaaaaggtcgtttttgaaacaaactcaggattgccatgaggtatggcaaaaccgttatctaaataggtcgactgcaatgcttctcgttctaagacggaacgctgaaagtccgtacgctgattttccgacgaaaagtcattttgactgatcagaaaatccagtgcttgttctttggtctcaaatcgttcaaaataaatcttcggtgcaatcaacatccgtgtatcttgcaggattttcaccttatccgcaatcggttcattatcaataatcaaatcgatatagtgattcatgatccgcttcatgtctcgattggtcaccatcggcgagatgcggacgactggtttggaaacatcaggtaaatcgatcgtggaaataatgaaatcgatggcagaaatatccatctctttgagcttagcgacagaagcggtttcaatactatcgacattaggcaatattcgacgaatctttgcagaaataaatgaactggtgccaacaccgttcggacaaacaaagacgattttattcaattgccgcatccgttctactgcagcttgaaagtgaatcgaaacaaacccgatttcatcctcagatattccaatatggtaggcctttagaaagtcgttcaaagagaaccaaacgaccccatacaacgccggataatgctgtttgatctcatctagcaatggattgactacagtagtttgggcctcaatgcgtaaaaacagctggtacaaatgaatcgtcaaatcttcttctaagcgactatcctgtgtcaaatcgatctggatgccttcactgactttctgaatcagatttctgactttccctcgaaaagagaacggaatcgattcgttcttcataaaaaaacgtaagccactacctacaatgagataggttaggtactgaacttctttcgatgaaaaatggtagatttcttgttcttcaatttctttcaacaattcataaatcaacggatacttgtcaaattccaaaaacaattttccaaattggcgcttctcttctatatccagctgatttgcctggttcgagcgctcgacaatcagcaagatcgaaacaacgatgctttggatgtagctttctgggatctccatttgcttttcggtgatcgaatggcgaaaagccgcatttatcttttcaaataatgacacatttgtcagaacagaaagattctccccatgctccatagtaaggagaatgaatcgcttcaacattcgttggatttgtgactcgcttccttgaaaataagtgcctgaattatcaaaacgcaacagtaaattttctttgacaaacagtgtttttagataagcgatatccttggcgatactgctcctagaaacataatactcatcagaaagttgctggtaactcaagtgctccccattgatcagccgcttaaaaatttgcatgcgtcggtcttcgatcaaagaataattgtttttcatttgctcaccctctacctttattctagtgataccttaacaaatatgaagaccaattgttagattaaaaaatgattaaaaggtgtgcacaccctttcccttgatagcaatatcggtcgtttgttccgcaaaatcgcttcaagcaagccaaacttttctcatcttcctcgttttctcttataataaatgtaaacagtcaaatgaggaggaaacaaaatgaaatggcgtgggggtagacaaagttccaatgtggaagaccgctctggtcgttccgcaggttcaggaggaaaaataatggccggcggtggtatcggtacgattgttatcgcagtcctcttttttctattcagtgggggtgatttaaactccgtcacagatattttaggaggcggacaagccgctaattatcaaacagaaaatgtggcttcagacgagtatacagaggaaaaagaattctccgctgtcgtcttcggccatttggaagattattggaatggtgtttttgaagcagaacagactacgtatcaagatcctaaactggttttatttacaggaagtgttcaatcggcttgtgggaatgcaacttctcaagttggtcccttttattgccctgccgatcaaaatgtttatctggatctcagctttgcaacagaactttctcaaaagtatggggccagcggagattttgccatggcctatgtcattgctcatgaagttggtcatcacgtacaaaacgaacttggtattacacagcaactcgataagatccgccaacaggtttctgaaaaagaatacaatcaatatagtgttcgtttggaactacaagcggattatttagccggtacatttgccaagtatctacaaggaaaaacttataacggccaaccgattttagaagctggtgatatcgaagaggctatcacagctgctaatgccattggtgatgatacgttacaaaaggaataccaaggatatgtcgtaccagatagttttactcatgggacttcaaaacaacgagttgaatggttcaaccgggggttcaaatatggtgatttggagcatggagacaccttcaatgaaaaaaaccttgatttggtctacggatcgtaacaaaaacgttcctttttagtcactcttttttcacatttgggcggtatagtttattcataccaacaaaccctaactttttcattttactccttgcctgccagtccccgctggcaggcccttttttttcatggtgctattttagtttttttttaacctttggcctgtttttttctttaaaacgctaagggttgatcacaattttttcatattttccggttactatataaataacccaacaaacaacccaactttttcattttttactccttgtctgtcagtccccgctgacagacttattttttttcttgccaaaattctcaaaatgcgctaaggttatttatgcgcggaagtggcggaatggcagacgcgcacgcttcaggcgcgtgtgagtatatctcgtgtgggttcaactcccatcttccgcattttgagcagatcatcttggatgatctgctcttttttatgtgtttcttttgtctaaataaagaaaaaagcttaagctagaagtatatcaataggaaaaagacaggaggaaatccaatgaaagaagtaccaacagcgaaaatcaaattaactgaggtcaaagaactctttgatgctggttatgaaatcttaggagaattacggtctgaggtgaatgccccagtcgttagagctaaatttctgaatcaagaagtgattgccatttatggaaaagaagcagcaaaaattttttatgatccacgaaactttaaacgtgaaggagcaatgcctaaactcgtccgttcaaccttgttaggggaagagggggttcaaactttagacggggaacaacatcaccatcggaaaaactactttatggacttgatgacacctgagagaatgaccgattaccatgatttgttggaacgaaacctttctcatgaactggataaacaatccggtacctttgagcttttttcactcacaaaaaatgttctattcaaaacgatttgtgaatggtcaggaatcaatctagcaccactgtctcaatcagagatcagtgagttagctgattatcaagttgctatgttcagcgggactgtcacctcccctgtcgcccatttaagaggcgtcgaagatcgtaaaaaatctgagaaatgggctcaaggattgattgaagaagctcgtcaacatcctgttgctggcaaagaatcattagcactttatactttcgctactgccactgatcttgaaggtaatttactgccgatcgaagttgcagccgtcgatctgttaaatatcatccgccctacggttgctttaaccgtttggatcgctttgatgggacatgccctttttagtacaacgactatctaccaagcacttaaacaaaacttttcggagttacaggattcatttattcaagaattacgccgcttttatcctttctttccaatgatgcctgccattagcttgcaagatgttgtcgtcgatggttatctgatccctaaggacagctgggtcgtccaagatatttatggtacgaatcatgatccgagaacctttgatcagccagatgacttcaaagtggatcgctttgtcggacgtacacaagccatttcctatgaggaagaatatgaaatgatcgcacaaggaggcggtgatttccgcaaaatgcaccgctgtgctggtgaatggattaccttgcatacgttgcgcgtgttcagtgatttactggtcaaccactatcagtttgaagttcctgaacaagattggaagattccaatgaatcactttccaacctatccagaaagtaaagttctcttatttaaagaagctgcaatgaccacagaaaatgagtaactactgatcgttgttattaagtgcagctcacaaaaacgcagcccaagcaagcttagggctgcgttttttgcttacttctctacagatgccgtacggaaataaaaataggcaccgtatgcgggaaattggatatctttgatcgttgacctgatcatataatttgatgcactctgatatagaggaacttgagctgcatcttctgctaacagaattgattctgctgatttgtaatcttcaaatactttatctggatcattggcatccacggtacgtgcgttttctgtcaatgccgtatagtcctcgttgacatatccaccgtaattgtaagaagaaccttttttatataaattgaaataagagtccaagtcattgctgccagcaatccaaccagaaatcgacaactcatattgaccatctgctcgtgattgattcaaattcgttcgtggttgtttattgattgtaatcgtcaaaccaggcaaatgatcttgaagctgattttgcagatattcaccgattttttgtccatgatcatcatctgttaccaataaagtcagttcaattttgtcaccgatagctgattgtgcttggctccattctgcttgtgctttgttactatcgtattcattgtattccccgctataagtgcgaaaatcttcattggtattcggattggcataaagcccactgggaataaggccattcaatacgcttgctccatcgttcaacacatcattcacgagactctctttgtcaatcgccaaagcgatggctttacgaaggtggacatttgccaatggtttatttgcctgtttattaaaatctaaaaaatagttggcaatatccttttgagtgactaaggagtcattattttggtactgttgcacatagagtccgctgattttttgcagatccaactccccgctttcaaacaactggattccagtattctcctctttgatcgtggaacctttgattttatccaacttaactaccgcttgatcgtaatactcaggatttttggcaagcgtccattctgcaccggtctgttgccagtctttcagaatgaaaggtcccgtatagagcaagtcttcacttgttttcccatatgccgtccctttttcttcaacataagactgtctttgaggcgctaaccagccaatcgacaccaccgataaaaaagaaggttgcggctgttccaaatggacgacaaaggtcttttcatccggtgtttctaagccaatcgtcgcaatgtctgctttcccttcgcgaatatcttgactgttgacgacattgtctaaaagatacgcatttggccccatggttttaggatcgaccagtttcttccaagcataagcaaaatctgctgcttgcacttgctgcccatcactccatttggcttcttcctttagtttaaaggtatatgtcttgccatcttcactgatgactgcatcctccgccaaaccgggaactggctgactcttttcatcaaaacgatacaagccttcaaaaagatgctggataacggtaaacgtaactttatccgttgtttgcgtcgtatctaatgttgtcaactctgccggtaagctgactgaaatctcttgaacttctggatctgtctcctttgcggacgatccagtcgtgctacatcctgctaacaaaaaacttaaaatccctacaacaaccaaaccctttttcatttactctcctctttccttttcacttgcgagttgcaagcttgattaaataaaaaaatcctcgtccctttgctgatcatcattgatcaacaaagggacgaagacttcgtgttaccaccctttttcgtgtcatttttacaaataacacctcatcagtacgtatgcatactcggcaggataacggctgcgttccgtctaaccagcgtaaaccagttaaaagactctgagctcatcttcacttagcgttctgtcccctttctcaccaacccgggttctctttaaacagtcatcaaagctactcttctcatcgatgtcctatattctactgaattgataaaagtatactattcctcgtttttcaagtcaaacagtttttagaattttcaatcttttcaataatggcttcaagactttttggagggcaaatacttgccagcttagtgttttttttctaggataaagaaaagaaaccttgctcgaaaggatgaaatcaatgaaacttgctgaagcattattactacgaagagatcttgaatccaaactcactctgttacgagaagagattgccagtagtgccgtgatccaagaaggcgatacgttagaccgcagcatcgacgacttactgctggattatgaaacaacaaaccaagaatttgcccagttggtcattgcaatcaatcagcgaaatgcggtcgccaaaatcggtggacaagaaacgattgctgccgcattagagaaacgggaagctttaaggcgttcgcatgcgatgctaacggcaacattggaagcagccaaggttgctccacggatgggacgtaatgagattcgtatgatccgaacgatcgataccaagcaaatcaccgaccgtttgaatcaaaccgcaaaagccttacgtgaattagacgggcagattcaacaaacaaattggcttgttgatttataaaacagctgggtgggagtcaaaagcgagcacaaagcaggtacaggcttatatgtacaccaatggggtctggcagggaccagtttaatgactgctgttcagttacaagcgtacaacttatatttttcaattaacgaccacgtgctggtttgacaaggtgggtgcctctgtttatcttttgttacgcaaaaggtaaacagaggttttttgttcagcaagacctctttcaaaagaaaaagaccccctgatccgtttccaacataggaaaccagatcaaggaatctttgatcgtttagctagttactttcttttctgtctgcgatataccactactacaatgcctactagtaacaagcctactaacatccagctgacttgatacgtttcaccggtttttggcagttcgtttttcttcgtcggtgtttttgtattctgattttttgctggatcaggagctttttctggcgtgtagcggttagtaaaggttggctcgctaccataatctgctttcgcttccaatgttccgttttgatctttgacatttacggtcactggaatctctgcgtcatcataagtgattgtactgtcttgtccggctttttcccggatcgtatagttgtactcaccggctttgtcgtacggaatcgcatcgaagtaaactttccctgtgccgtcgttggtttggctttgaatcacttgtccctcttgatcgactaattcaaaggtgaactcccctgcgactagtgaacggccagtcaaaactttctcagcttccaacactacactgccggcttttggtgtgtaagtgttcgtgaagacggcgttgccttcataagtcgctgttgcttctaactgtccgtcgttatttttcacctctactgtaacattggtgattgaatcatcatagctaatcgtagcgtcatgtccttgtacttcataaattttatatcgataggttccttctttttgataagtaatctcatcaaaaagaatattatttgccttgttcgtcttttcttgaaggattttattttcttcatctgccaaaacaaaagtgaattccccgtcttcgatctgtcggccttccaaagctttcgtagccgttaaagctaggctagtttcgataatttcccttgtattagctagttcaaagacataatcgacttcctcgttcgagatcgtaaacgtatattctttttcatcccgctcatatccatctggtgctttcgtttcttggattttataatctccatatcgtagcccatctaagtggtcaaattcgctagttccttgaatcaacttattatttctgacaacaagttcggagaaaacaacttcgtagtttccttcggcatttttacgactgagttggaaatgtgcctctttgttgatcccagcttccttatccccttctctgtcatatttattgattgtcaacgagccatttgttcccgttgaagtaccgctaccgttggtagatttgacgattacgtcttttgttacttgatggatttccgtctgacttccgtaaagagacacatcatttgaaacaacttcattatttcgaatgccaggatcaagtttcgtttgataaacgatgaagtatggactgtcaatgacatcctcaaaagcaatacgtaatgtgaatgttccatcaataccattcgttgttacatttggattgtcttgattattgaaaataactttctcaccttttatccattgatctccgtctttgacggctttatacacatcaacaaggacttttcctgtctcatcgtacaagaaagtctgttgattataattgatcgtatcttcaatcacagcattcttgatcgttcgactatcttggttaaccagcacttcccaatccaacagtcgattattgtcaacattttgagtgccattttttgttaaccagtttccttttgcggatttctcaacttacgcttcagcagttaaatccgttgtaccatctgtcaaagagatcatattattgtacttgtaaacatctgtagctgcttcgacagcaatgaagacagcaatcgtttctgaagtgtctttcaacagttctactgtcacttgttttgtcactggatcatacgtcaagcgataatcagctgagctcaattcttccttcagagatcttacttggtttcctgttccggatacgtcaactgtataaactactgcttctttaaacgtttgaccatcttgtaattgatcgacaatcttggttccttcatgaagtgtcgctttatacgtattaaataatcccatccaatagatttgatcacttgtagcaacatcttctgaaaagatatttgggaaattacggttaaaagctgcttgcaagtatgcttttacatctcctccttttggaatgaaaagccctgcttttagcgcgtttaaggtccaagtagtgtccatccatgaatttgcttgagcggcttccctataagagttaccgtcaatttcataatcgacaaaagcagaattactaaaacgtgttttggcacttcctaaagcgatctgtgtcgtcatatcaaaagtcgttttgaatctgaccgtaattttgtctgctgtctttgcatagtttccttttagtttaatttgaaaaccagattcgtactcaattggattttctccagaagtggtttcacgctgcttcgataaatcaaagtcgcttgaagtcaattctttaacttctcctgactggctagttgcagttaaaacaagagagtcttcaatcaattctaatccactaatatttgtcccgctaatttctcgatagcgatctgtgatgaccatattttccacttctacatattgctgatttatctcaatctgccattgaatcgtttgatcctgataactttttgatggtgctgtttttgtcacaccaattttgcttgttggggtcactgttcccgacccattatgagaagttgtcgtatcatctttgatagttatatagttagtaattctagtattcgccagtactggatcaaagagttgtgtctcataacgaatcacatattgtccagcatgagcgaacacaagttgaaattgaacaagctgattatctttttttatttctcctgcttcatcaaagtgccaatctgtcacaatactgttatcatttttgtttctgaccactacagaatcggctactaaataatgcaatgcattttctgaaagtgatccagaatacgttttatcaatgagaattgaaccgtctttgctaagatctaaagaaacctcccaagaagcacgaccagttgactgatcataacctaaaaatcgcttatattccgcagattcatcatagctgactgttgcttcaactgatttttcatggaaattatctccagtgatttgagcaacatttttgaaggagttaatcgttggatcattgacaacactataaatttcaattttgactggcttatcgattttttgattgaatgtaaaagttccagtcgttgagttataagtatacaagtcgctagttctaacccaagcgtctccatcataaaggtaaccataagaatgagaatatgccaatccgcttggtagtttatctgtcacaacgacgttttctagttccttgctttccgtattatatacgatctcccaaacaattgagccactagtacttactttcccactcttcgtaatatcgatttgatagattggtaaagtaatcaggatctcattgccatcacggtcataaataccagtttcgatgacaacatcttctgtgattgttgacactttcaattcggtttcaagattgattgtcccacttctacctgatagattctctgcgttttcattgaaaacaatctttaattctccatttgcatttagataaaagtctcctaatgatcctccacctgaacgctgtaatgtgcctgacacctcattgtgaacagcaaaatagcttggtagctgataaatataataatcaccgtttttgatttcctcctgatcagataatgaccagtcaaagtgaatcttaatattgtcgttataataaggaggattgttttgatcaaaaggttgatcattcatatctgtaattcgtacattatcaaatagttgaattcctcgagcatttaaatctggattaacagcatttggagtgactgcttgttcggtagattcagtctctgaatcctccgtgggtgcacttggctgtattgtattttgattcaactctgaagtggacgtttcagtcgtagtagtagtggtcgctttttccggttgactgtttgaggtatcttcgactgtttgactagtactctccgcgttttctgaagttgttgttgattcttccgtttttgtgtctgtcgcaggtgaattcgattgactcgtttgactttcaacttctatatttgaaaccatttcagctactgcaattgccggtgtacaaaaagtcgcacctagcaaaaccaacaagctcaaatatgcacatagttttttattcatagtgattcatcctttctaaaaaaacaactgttactttttagaaaaacttaatttttttacttttctaaaatataagtttttctaaaagaaccaaccaatataattatttatgatggcaccgtactgtacgttcttccctcattcttccgaagacagcataacgattgatatagctagaccagaacctatttttcattcaataacataccttttttatagaaaatcagagacaagtatcaataaaaaagcatgtgttatctcacctttattttcccaaatttggcataaactaagtgttcaaaaaaaatcatttttcaaatatttttgactatttggaaaaacgtgctaccatcaatacataactgattggaggaaagctatgttcagaggtttattgtcaactgcttcacaaataaaattgtagttgattgaaagtttgttgcatgaccgtcactgttttattgctgatttgctggatgaatttgacctgtctttgtcgttgttcagaaagtatgtgacagagatcaatcacgatctgtcctttcttcaaataaatatagacaatcattcctaagtgagtctggaattccattctttcgcttcacgatcggatgtctatagttttttcttggctgactcttctgctttcaaactcttggaacttctgttttcatcccacttttccagttatgagacactagcgattgaattgaatctaagcaaatcctcaattattcgtttaattaaaaaaatcaacacggtcatacgtccttttgattttcatatagaaaaaaaacctatccgcatagccgggaatgaaatgactattcgccagttttacatggttttctttttggagaaataccaacatgagtttagagatgccagtaaaaatcaggaacaagaatttttaaaagttgcacaacttttggctgaagttactccattaaagctgtatttttctgacatacgaaaaatagcgtttatcatttatgtacatagtaaacgagagaggctttttgccacggaagtgcaatcgaataaaattgaatattttctagaaaaaatcgatctcgctgaattctctcgctacaaacgatcttatttagaaaaagttatgggttatctgacttctcatatcacagccgacccagctatctataaacaagtaaaaaaaatcttctatcgattgactaaacaaatttttcttaaataccattacaccgaaacagactttcaagaaaaattggatgctgttagtttcaaatatttgctggaaacgaatttgaatgttccgtattgtattttgaatgatcgcctggcccattttgttgataactgcgatcctgtccagcaagcaatcaacaaggatattgttcagctagtgactcattctgaattaccggcgattcgccctgctacgatcaaccatttgatttatattttccatacttcttttccactatttacaaaacaaatcattgatcaacatgcagattatcatctcgccttgttctacgataccaatagcgaccatacggaaatgatccgaacacaaatcaaacagttcgtcccctacgacctgaaaatcacgattctcaatccgttagactctttttcaatccctgccgtcaaagcaacctatgatttgattatcggaaatatcgtccctccttttcagaaagttcctttcaaagcaacagacatctttattacacgaaatgagattggctatatcgcaaacagtattcaagaaaaagcgatccagcagattgagaaacaaaaagaacctcttagccctactcactgaaaaagtgagtttcgctaaagaggttctttttaattttgtcgttcgagtaattgtttgccttgagcactctgataaaacgtttcaattaaatgatttaaatttgtttttgtctcactggcgccaaaaagttcaccgccaggttctagcataagaccattggctagacgaccgatcactaccggatcaaagccaaagtcgtcaacgattttggccgtttgagacatagattccggatcattaccagcgattgccatggcttttctggctggtgaaccagccggccgagcttcgtcttgaacatcatgataacccatatggttgaatgccttgataactctgctttggtcaaaatatttttggaccctttctgaagatgtttcttcaacagtcgaatacgttttgctggttccatcaacttcccaccaatagttcattgcatcgatcacaagtttaccagccagctgctccttgggaagtgacggatagttgcttaaagggattgctaataaaatgactggcatttccgtcaggatgtctgagacattcttcacctttgcacctggagcaaggatttcaacagctagagcattcttttccgctggctttctgctagcgatccagacctcatacccagcttctgctcctaattttgctaatgctaaccccaacttgccggctcctaagatgccaattctagattttcccattatttcccacctgatttcaagagttctttgaccctagggattacttttgtaccataaagttcgatagtccgcagacggtctttttgtaattgtccaccggttccataaacaagatcaaaccgttcgacgccgacttgcggcatcgttcgcgcaattttttgtgccacagtctcaggactacctacatagtaagagccatgttctacttcaaaatcgaaacgttctttcgacatctcgggccaaccacggtcttctccgattttatccatacttttcttgatatagtgccaaccgatttcgtacgcttcctcatccgtctccgcaatcaccccatgggaatgcatccctaccggaagaatcggtctgcccatttgctgcgttgctttttgataaagttgtacatagggggcaaatcgcgcaggctccccgccaatgatggctagcataactggaaagccgtagcgaacagcacgaataatcgactccggtgttcctcccacgccaatatacgtatccagtgttccttcgagttttggataaacttcggcattctccaaagattgagtaaatttgcctttccaggtcagtggctcccctttaaggagttcgtaaaacattgctactttttcttcaaataattcttcataatcttgcagatcatagccaaacagtggaaaagattcagtgaatgaccctcttcctaacatgatctgcgcacgaccatttgaaagggcatcaactgtcgcaaatcgttcatagacccgaactggatcatcagaacttaatacagttactcccgttcctaatttgattcttttagtgaccattgccagcgcagctaatactgtatctgggcttgagattgcatactcttcgcgatggtgttcgcctaatgcgaggatatcgacaccgacttcatcggccaactttccttctgcaataatatttcttaatgattggctgtaactgattcgttgatgggtctggtcatcaaaggcaagatcgccaaaggtatctaacccaaattctatttgtttattattgattgtcatatcatttccctcttttcaaatacttcctgcattcactataacaacttctttttattaacgcgaaagatatgcttactttttgtaagtcaactgtttatgaattgcttcaaaaagaaaagcgcgtccttgcttcaaacaaggacgcgcacttttttgtttttttattagccatcagagatagattcctttgcttcttaaattagctaaacactcctctaaatacattgcagtatgttcaggataaatagggactgattgctcaatcggctctaacacctgataaggagctgtcttttgcccccgataagtaggctctaaccacgctgctgctggacgatagccgcgacgctgcatctctgccatgacaaggagatggtattggtacagcttatatggagaatgagcaaaaacgtaatcgactgtcgcatgtttctttccccagccagcgcctctcagcgcagctacttcccgatgctgtcccagtaattgttgtcttggtaatttaggcaaaagtgcttcatgccacaatctcatatcctcagttcctctgcttcgcttgatttatgtctgtaatttattggttgtcgagcacgattttccctaccgcatggtgtgtttcacttaatgcatgggcatcatagacaccttgacgagtcaatgggaaagtttcgccaatcacacttactaatttgccatcagccattagtttagctaattcgcttaactgttctccatttgtacgtaaccaaattgcttttgcttcaatttgtttcgttgcggctaatgtttcatcttcaatactcagtacagaaatcaagcggccatgctcttttagaacggagaagcttttcttttggatctcgccacccattgtatcaaaaactaaatcaatgtcagtaagaacttcttcgaaatccgttgtatggtagtcgatcacttcatctgcacctaattttttaacaagttcatgattacggggacttgccgtcgtgatgacataggcgccggcatttttcgcaagttgaatggcgtaggtcccaactccgccagctccggcatgaatcaacactttttcgccagcttttaacgaaccatgatcaaatagagcttgtaatgcagtcaatcctgctagaggcacagctgcagcttccgtgaaggcaatagattctggcacaggcgccagtaagttgctgtccacaatcgtataatccgcataggtcccaaatcgtgtcgtctctggacgagcgaaaatccgatcgcctacgtgatagtctttaaccttctgaccaacttcaacgatttctccagcaacatcccatcctagaataatcggaaatgaccaaggaaacatttgcttcaagtatccttcgcgtaatttccagtcaattgggttgatcgaagttgctgcaactttcaccaacacttgatccgcaccgagttcaggtagtgaaactttcgcttctgctagtttttctttaccaccatattcattaataacaactgctcgtgtttccatgtaaatcactccttgagattatgtaaatgagcttccgtcatttttctaaagaaacgaaaggtctctttcatagcttaggcaatgatccctgattttacaactgattcgactttcccttttctatcagaaaaagcagttttttcactgactaactttttattgcctttttaaaaggtttcatttattctacaggaataagaatgtgataagaaagaaggaattgatgaattgaaaagattgcacgtattttttggcgggatcattgcgatcctaggtattctttttgttggcaaagctgtactgtccaatgaaacaggaagtgcatcagcaaatgatgctaacacggttattatttataattggggagaatatattgaccccgatctgataaaaaaattcgaaactgaaagtggctattcagtgatttataatacatttgattcgaatgaagcaatggaaacaaaggtcaaacaaggcggtaccaggtacgatttgattttccccagtgaatcgatgattcctaaaatgattgaggagcagctgctgattcctttagaacatgataaactcgtcggcagtgaagatctttctgattttctgatggatcagcgctttgacaaaaacaatcattactccattccttatttttggggaactattggaatcatggttaatagtgaccaaatcgatcctaccaccattcatggctgggcagatttatggcgcccggaatttgccaacgatattctagttgttgatggcgcaagagaaacgttaggaatggctttgcagactttagatctttctcaaaatgagctagatacagcaaaccttcaacaagccatcgagaaattggaagcattacgccccaatgtcaaagcagtcctcactgatgagatcaagactttgatggtcaacaacgatgcaccgatcggcattggctattcaggagatgcagcgtatgtcatgtctgagaatcctgctataacctatgtcgtccctaatgatggcggtgctatctggacagataactttgcgattccaaaaacagtcggcaatcttgaaggagcttatgagtttatcaatttcatgctgcgtcctgaaaatgccgctcaaaacgctgagtatgtcggttatgcgacaccgagtgagaccgcgaagcaactgctaccgactgaattgacctccaataaagctttctatccagagccggaagcaatgcaacagatggaacactacgaatacttaggaaaaaatgccgttgaacagtacaacgatctttttctcgaatggaagttgggattataaaatgaatatactattgaagtcttcctacatttttgatacagaaagaaaaacgacctttgctggttttattttgattgaaggaactaggatcaaggatgtgggtcctttggatgccacacctaccaacttaccagctgaaacaacgatcattgattgtcatgaccaaatgatcattcctggctttatcgatgcccatattcacttttatctttccgctttgctccatgcagggcagttaactcatgtcactggaacaactgaagaagcagttgcccagcaagtaccgcaaattcctgtgacccatggctggaaaattgggattggttggttcagcagtgactttggacaacaagtctatcccacaaaagcaacgattgatcactactgtgacgaagtgccagtcatgctgatttcaggagacgcccacagcatttggttaaacagtaaaggaatggaaaccttagaaatcacaaccgattcagttcctaccggaatcagtggagaagcattgatgaaagatggcgaattgacgggttgttttcttgaggcagttgctattaattacttggcggaggtgctgcaatcttttcaagccaacagttactcaacgtacctttcttacatgaagcagctcaatcgttatggcattactacaatcggcgatgttgccctgactggcgaaagctgggacgacttgatttatccagagctttaccaaaaagttgccgaaaaagcgactttacgggcggttttttaccctgcgatgcgaatggaaatagagcatttaactgatatctatcaaaactatcgatctgagaaagtccaaatgggtggtgtgaaacagttctttgatggtgtaacaagtacccatactgctttgttgaaatcggagtacgaaacgccttattttactggtgatattggtatgccgctgattgcaattgaaaaaatgcgccagttgattttcttagcaaaccagcaaaattggccgatgcgcatccatacgatcggtgaccaagcgatccatcaagcgttgtctttttttaatgaaagtcatgcgcgcttccctctctctgccggtaaaaataatacactggagcatttggaagtcatggatcctgcagatctttctttagtggcacaagacaatttagttctttctgttcaacctagtcatttattagtcggctatgaaacgttagatgaagaagtaggtccgcaacgcgctagtcaaatgtttccttttcaatcctttttggcccacgatgctgtagtagcatttggaaccgacagcccagtagtgatcgatgtgtctccattggattcgatctattatgcagtggctagaaaagaaaaaaacggctctccagtagaaggattgatgccctctgaagtgatgaatgtggcagatgctctggttgctcataccgctgatgcagctcgggcactcagtcgacaagacattggttcgatcaaagtcgggcagttggctgatctttgtattctttcgaaaaatattctttccctttcagaaaaagagctgcttgaggtagaagtcactgcaaccatttttaacggtgcatttgtctatcaaaaagacgaagcttcgcagcaaaattcctaattggatctttgaccatatccctcgaatacccgaataatggctgacttgcttctctcgtccgagggctctcattcatggaagacccttgactgtgttcacgttcacgctaatcaaccgtattattcgggattttttgtcaacaccaccctaatcccccatccttttttcgttctggatactgccaggctataatttggttcctcttgattgttccctctgatcatttctcgctttgtttcgtcttgattcctgctcaatcattgccctcttgatttccctccaattccttaaaatatatacaatatgaccaacaggatcccaccaacgatttcacttattggatacttgcgattaatcggtaccaaacaattcctgcacttgccttttaagaataaaaatgaccaaatagggatcagctgccacggggttagtacctttccacagtgctcacaatgagagcggcctcccaatgattcctgacggggcaaacgataaacaacaaccatcaaaaaagaactaagacagctaccaagactaaatactgataaaatgggtaatagcaacgctcttcccaaaccacacactcctctcgtctaatcgacacctcaaataaagagcctattcataagcaaatacgctcttttaaacacgaagtttttttattcttcagcgacgtactgctgacagcggatacctagcagtacgtgatcgtctgatttatgtcatcaaattgattggatgtgactctagcctcttgctcttatttgctactgctgacacctcctttgttgcgaaacaaactgagtgttactgaccatttcttaaagaaaattcattgatgattcgaggattgatttcccacaatagtcgattccaatcctctgcgtctggaattgacttaaaaagcaaatgccagtttccaatcaattgatcactgacatattcactataatttgtcactactagatcaatatgattctgctctaaataatctaagttcatctctaatgcattcgggaaaaacaggtgctggaaccggccaagatatttgatagccattgcttggatattctgacaaacaaggtagtttccctctaataaaaatacaatatttttaggtgctccccaatggatttcctttagtgagtccatgaataggacggccatcacggtgatttctgttactgctgtctttccccctgagattgtctgatggtgttcggtaaagaatgctaataactcaagatacaaatctgggtatttctcttggacgacttcatgaatatcaagaatattttgatttgtgactggtgatagctgttcttttaaatacagcatagtaaaaaaagaacgcacaaggatcatgtctctctgaaggtcattactctgctggccaaaagcggataaaaatagttgggcacagtctgtaatcccaacattcggctggagttcctgaataaactgctgctctccagccagatccgtcaatgaacgccgacacaaaatcatcacatacaaatacaataattcctccactggcaaacgtttcccgattgacgcatcaatcacatcattgatagttgaaaaacgctggaatgcctctcgttctttcagcgcttgaatcatttctgactcgataagcaagtctccctcacgttctaaagtaatcattagagtataactaaaatctcccaaagaaacattgggatagctgctgaagaagtgctttttttgtaaggcaaaggcaatcgactggatggcaattgatggcaagaccgtgtgtggagttatttctgattcataataaaaatcatgaaagaaactgcgaatatcgatttcttttccaatgaaatccactttcttcagggacagtgtcagtcgatagcgcgccaattcattttctaccattttgaaatagcgcagcaaactactttctgagaagtggagttgatcggcccattctccgatctctttgatctgcctttgaaaaatcccttcaataatgtgaaagagtggttcattttcaagcaatgaccgctttttagtttggtacgcttctcgattggtttctttgaacaaatagcctgaactcgtgttttcaatcagaatcgactgctgaaaatattgccgaattccggtaatatcggcaatgatcgttcgtgaagtgctttttgtgaattgggctagttctttgactgatcgcgttggtattcgctcgaaggtatgcaagattttcagccatcttacagtttccttattggtaataaaattaagttgaaaatttttcatctcttttctccttactggttttcattgccgttattgactgaatcgttttccttattatacgccctgcggaggaattatactcagttgcaagcttctggcagcaccagttatcgtgatttatacgagataaaggaacccagttatgaaaaaaacggtcatcttgacaaaaacaggtatcgaattgtataaaattgttattttttgttaaagccctcttgattgtaagcggtatttttgttattctttaaaggtagaggaggtggatagtgcagtgtatgctatcaagatatttcatggttatctgacagcacaaggaaaaagaactcgagataaatcaattgctttgacttatacatgcaaagaagatgccgaacgcttcgcaaataaaattggcgggagagttaaaaaaattggataacctaaactattgaaaaagagtcgtcgaccattgattgttgaccactctttttgttttgttaaaaaatattctctaacaaatccttttttctatttgtttttatttctcgcttgtcaaaaataaaaatacactgctgcgatcaattgttgaatggccatttcttccccttttcacttctattagccaaaaaaaaatgactgaaacgtctgagttgaaacaaagtgttttctcgctcagaaacggttcagtcattttctttttatggaatagcgatagtcacatcgactgtctggatcgccacgtcataaaacggatcttctcgtcttcccaagaaatcttttgcttgagctgggaaaagtgcatacatcagtacatcttcttccgttttggcatattctttgatttcttgctcgaattccgggagctgcggtggaatcaaatctgctggtcgttcggtgatcactgcttccgtcccaatgattttttcttggatcttcgttttgattggtgccggaggacgaccgtaaagaccacgaacgtaatctttgatctcagttgggactagtttgtagcgttccccagaaatcacattcatcaaagcctgtgtgccaaccatttgagacaaaggggtaactaaaggaggaaatccaaggtcggcacgcactttcggcacttctgccaatacttcttcgtacttgtcctgcagaccttgttctgtcaactgactcaataagttggataacatcccaccaggcacttgatagatcagtgtttttggttctgtatctttgactttaggattcaagatcccttcctctcggaaccgatcgcggattggattgaaataatcagcaacttcagccaatttctttttgtccaggtttatatcaaatcccagttcttctaatgcgatcgccacagattctgtcgctggctgactcgttccccctgcaaatgaagaaattgctgtatcgataatatctgccccagcttctgcaactttcaaataagtcatttctgaaataccactagtagcgtgggtgtggacctctaatggcagatccacagcatctttgattcggctgaccaattcaaatccgatttgaggtgtcagcacaccagccatatctttgatacaaatcgaatctgctccaatatgggccatttcttttgctaattgcacaaagtattcaacggtatgaacttcgcttgttgtataagagatcgctgtttggcaatgaccaccagcttcttttgctgttgtgatagaagtcgccaaatttctggtatcgttcaatgcatcaaatacgcgaataatatcgattccgttcttgatcgatgtctctacaaattttcgcaccacatcatccgcataatttttgtatcctagtagattctgtccgcgaagaagcatctgtaatttcgtgttcttcacttcacggcgaatctgtcgaagacgttcccaaggatcttcatttaagaagcggatacaagaatcaaaggttgctccaccccacatttctaatgaatggtagcctacttcatccaatgttttgatgatgggcaacatatctgacgtcggcattctggtagcgatcaagctttgttggccatcacgtaagactgtttccatgaattgaattttcttagtcatctgcttgcatccttccttttgaaactaattcatttattttttgctgtattgcttcgactgaatgcgttctcgatcgtccgcatagttttgcttccttgtcacaaagaaagcagcgccgtcttggatagcctaacgcttcgcgactgatggactgcacttcacccgcttctagccaaagcacgtcaagatctgctaatcgcccataaggatgtctttcttcaagtgccaccatccttttctttagttcttctttttttaaaggaagtaaaagaaaatattcatagccagttttttcatttcgataaagatgaaggaatgaaaaggcatccgccactgctcgctcgacttcatccgtcaagcttttaaacacagcttctaactcatctgatgttttgacaggtccgggaatattcatggtggcagatagcagtgtgtattggggcgccgactccagtaactccttttgccgttttgcacgctgttctctagccgccaatacttctgctaatgaaacttccggtccctcaaataacaagctacacatttctcacaacatcaatgagcgtgccgtctcgatattcaatcaatgccactactttatcgccataatgaatggcttcaggcgttccaacaatctggtaagctttctcttttaactcttcgatcgtatactgaggcacatctagtgttttaaaatgttcaatcaaatcttgacgatctggattgatggcaatccctacttctgtcacgatcacatctatacttgttcctggagtgaccactgtatttactttgtcaacgatcgttggaattctgcctcgcactaagggtgaaataacgagactcattttgcatgccatactcgtatcagagtgcccgcctgacgctccccgaatcacaccatcggatcctgtcatcacgttcacattgtagtctgtatcgatttccaatgcggacaaaatagcggtatctaattggttgatcactgatcctttacttaacggcgaagcatacatctcagcatcgatttcatagtgtcctgcattgcttcctaatgaaacggctgaagaatgatcgaaatcttgtacatcaatgattttttcaaccaatccttcctccaatagttccaccattgcattggtaataccgcctaatgcaaagctcgcttttattccatctttaagcatcgcttcgcgcaaaaagcgggaaacagctaatgcagcaccaccggtacctgtttgaaaggagaatccctctttatagtaaggagaatttgtgatcacttttgctgcgtattctgcgatcaatagttctttcggatttttggtaaagcgggtggctcctttggcaatcccttgtgggtcaccgattgcttccacttcaaccacataatccacgtcggtttgcggaatactgattggtgtattcggaaatggcacgagcgtatctgtgatgatcacgactttgtctgcatattttgcatcgatcattgcgtaacctaatgaaccacaggttgcttttcccaccgtaccattggcattgccataggcatctgcacttggtgcgcctaaaaaagccacatcgatatgcacatctccagctgcaatggcccgagcccgaccgccatgtgaacggatcacaacaggattttccatgattcctgctgaaatagcagcacccacattgtctctcaatccgctggaagtaatattggttacaacgccatttttgatatggtcaatcaacggtgcatggacatttgcgatggagctaggggcaatagaaatatttttgatacccagaccagcaatttcttccaagaccatattcatgacataatcgccttcacgaaaatgatggtggaaggaaatcgtcatgccatctttcagccctgtcttttcgatcgcctcgcgaatactgctaagaagtttggtatctcttggacgaacgggggtaacggtacgacttgcttcttgatacgtatcgatatgcgccaattccccttcaaaaacaccgtattggtcagcatatacttgtggaatatcttttcctactttattcatgaccatgcctaaatatcctcctccgtaatcaacttcgctgccttagccaatgcaatcactcgctgtgcacgttcaacgattggcttgtctaccattttcccattgactgaaataactccagagcctttcgcttcggcctcgcgaattccccagataacttctttggcattctggatttctttgtctgtcggtgtataaatagcatttaccaacggaatttgtcgtggattgatcactgactttccatcaaatcctagctgcttgatttgttgcacttcattttggaatccttctacattgtccacatcggaatagacagtatcgatagccgcaattcctgcagctctggctgcatgcagaatcatgttgcgggcaaaggataattcctgtccatccggatagcgcttggttttcatatttgtgacgtaatcttctgctcctaaagcaattccgatcagtcgctctgacgctttggcaatctcccgtgcgttcaataccccttctgcagattcgatggctgccatcattttcgttgtgcccactggaatctgattgtctttttcaacagatgtaatgaccgcatccacatctaaaatatcttgtgccgtctctgtttttggtaagcgaataacctcaacgccagccaaaaccattgcttcgacatcttgggcgccacctgcctccaaactattaatccgtacgactgtttctacattgctgtaatcaaatgttttcaatgcaaagtgaaccaatgtacgcgcggagtctttttctttaagagaaactgcatcttctaaatcaaacataattgagtctgcaccatataagggtgcgtcccttagcattgctgcatttgcacctggaacaaacatcatggttcttcttaagcgttccatgaatcaatctccttccaatcatatgcgtctttttttgctgcccgatgaatcgcggtaatggttcgagcttgaatcgtacaatccaaagcgcctttatcaacggcagctactcgaacagacttgatccctaaatttttgatggtctcttcgatcacctttttgatttgttgaccaaattgtttctctacactgctttccaaagaaatttggatttcgtctgcttcagtcggctcgacagtaatcaaaatgtcgcttgactctactgtaccggctactgcgatttgtgtaatttccatatggtttcacctctcgttttttaaataatgatatgtcgttgatggcaaaaattgtctcaaacggcggtcatcctgatttttcaaggcttctctaactttggtagcactgatgatctcaccatcaatactcaatctaggtaaaataaccaattctaatgagtcgccaaacatttcctgcatcgcatgattatacgtatcggtcacctttgaatagggttcttctccgacaaaccgtgtccgaatgtctaatacaggtgctatcttctctttaaacagttgcgcatcaacctttgcctggatcttcgctactgtttctatggcactgtctttcagaaagtaggaaggaaacgttgcggaagatacaaggtaatcattggtgggaaaaactgttacattggacaagtgtgcgactccacgttttaccatttccatccgatctgcagtcgaaaactttgaacgatcttcggataacacaaagacataaacttgctgactctgctgcgcagctgtctcgacaagatactgatgtcctttggtaaagggattggcattcatcactatcccgcttccgatccccatttttttccctttagccagcgtagaaagatagctcgcaaaatttggcaatcctcgttccataaaaagaatttctgaggttgcgatgattttctgaaaccctagtgagcgaaagatcaattcattgctgggttttgaatacaagaaataatgttgttccccttcttctgccaagcgatcaaccagatgttgaatgatgtccgtcagtagattttctgattgaaaggctttgcaaacaaccaagcatttcaatatgttgtgataataggatccagtagcaaccagtaaatcgttatcgtagattcccactgtgtaatcaagttcttcctctttattcagaccggctcgatccatcaaggaagcccactgtttatagactccttgatctcttagccatagccgttttaatgaatacataaacgtctcttctttatctttttatttttttattggaaaaagtttgctaagcagcatcgaagcaagatagataatcaagataaccacgaagacgccgccccatcccagcactaataattccagtgatttcattaaatctgctgacatcgaatctctcctttcttaggttagtaaggcaagcaataaaccacctgcaataactgaagcaatctgaccagaaacattggcaccggctgcatgcatcaaaataaagttttgtgggtcttcatccgttgccattttttggatcactcgacttgacataggaaatgcagaaatccccgcggctccaatcattggattgattttttcttttctgaacaggttcagcacttttgcaaacaagacaccacctacagagtccatgatgaaggcaaccaggcctaaagcgatcaccatcaatgtatcgacttgcaaaaattcttcatactgcatttttactgagatagagagccccaacaaaatactaatgatatttaccagctcattttgagctgtgatagaaagtcggtctaatacgccgcattctctcaagagatttccgaacatcaagaaaccaactaatggcagagatacaggggcaatgagcccggcaacgacagagataacgatcggaaaaagaatttttgctgtttgcgagacttcgccagcgcgataattcatatgaatcgaacgctcttttttcgttgtgaccgccttgatcgcaaccggctgaatgatcggcaccaaagccatataagaataagctgcaaccatgattgctcccatatatttggaattcaaagtgttggctacaaagatggatgttggaccatcggcggctccaatgattccaatggaagctgcatcatttaaatcaaatccaaataaaacagcgacgataatcgtaaagaaaataccaaattgggctgcagccccaaataaaagcagaaaaggattttggagcagcggaccgaagtcgatcatggcaccaattccgataaacaaaagcaatggaaataactcggttgagatccccatatcaaacaatacttgaaaaggaccaggttccccgccagcactcaaaacaccagagttcgggaaatttactaaaatcgttcctagtcccatcggaactagtagtgttggttcatattcttttttgattcctaaatacatcaggatgccaccgactaccatcatgacaatccgtccgggttcttgtcccatccctaaaaagccttcaatcagagtttccactaacgtcacttcctctattcattaaattttttattgattcatccctattaatgaatcgtaatcaatgggtcaccaggattgaccatctctccttgattgacatgaataccagctaccgttcccgcttttccggcaacaatctcattttccattttcatggcttctaatatcatcaatggttgattttccgccacagtatctccaacattcactaagattctcaaaatcgttcccggcattggagaaggcatggcatctgcgcctgcggcaatgggtgcctcagaaacagatggtgcctcggatgcggctggtgttgcggtttgcggagctggtgtttcaactacaggttgaacgggtagtacaggttgtggtgtaccaccgatttcttccatctctactagatattctttgccatcaatcgaaattttaaatttacgtaacattgtttttcctccaaaatgctaatttttgttgattcttcgaataacaaactgactcttttcatttaatccagcagctagacttgacgcgatgatggaaacaagtttcgcctccggattgcgctgcattactttcttgaccacaaattggctcttaggttgatcacctgccgcaatggctgtcgcgatcaaactaacaagttgatattcttcttcactagcttcgatatatgcaggaaccgctttccatttcatttcagattcattatcatcgagcgtttcagaagatgtttttgttatttcttgatgtggttcactttttttgaacagtcgggcgaataatcccatgaagttactcctttcatttttttcgttctcaaccacattatattgataatggaccaatccggtagttctaaatcaaagattattgttttttttctgttcctatttcttcgccttacaacaaaaaggcttataaacattgttaaatcaacgtttatcaaccgttaagattttattaatatcttgttaagcctcttttaagaacacctataccaaattgtttttttcctgttctttttcagaattcaatctatcttatcaaatgaatattgcttattctatagtcgtcaaacggaaaagctaattgtttccaatacgtgtctttctcccccaaaaggcatgaagatttgttttttattggaatgaattggcaccgtttacaaaaacagaaattattaaatcagttgtagaaaggaagaaaaatatgttattgacggttttatcttatgccatgattattgtctttatgtttgtaatcatgaaaaagaaaatgtctccattcacttctttggtggtcattcctttgattttcaccttagttgcaatggtgtcaggagtatccaaagaaggaaacatcggggattttgttctagaaggaatcaaaacaacttctaatacggggattatgttgctgtttgcgatactatacttctcgatcatgctggacgctggattatttgatccgattacaaaaaaaatgatctatttcgcaaaaggcgatccgatgaaagttttgatggcaactgctgtcgttgcggccaccgtttctttaaatggggatggaacgactactaccctgatctgctgttcagcctttattccgatttataaaaaattaaacatgaaaatgatgaaccttggggtactggtgatcttgcaaaataccattatgaacttgctcccttggggaggacctactgctcgagctatggccgttttagaagttgatgccgatatccttacttatctggcaccaggaatgatcatctcagttctttatgtcatcttctttgttgctcgcagaatggggaaacaggaacgggcacgcttaggaatcactgaattgactgcagatgaaatcgaagaaatgacaacggtaacagaccctgaaacactacagattcgccggccaaaaaactttcttttcaatggtatcttgacgattggattgattgcatggctcgtagctagctcattcattgattcgattgcactgccaccacttttgttgttcttagttggaacgtgtattgctttaatggtcaactaccctgttttaaaagaccaatcttcacgaattggagccaatggcggagatgctgttcaagtcgttatcttagtctttgcagcgggcgtatttatgggattgttccaaggttcaggtatggcagaagcattggctaacagctttactcacattattccgaaagaattagccggcttctgggggctagttatcgcccttatttctgcgccaggtaccttcttcatctcaaatgatggtttctattttggtgtgctacctgtattagcagaagcagggcgtgcttatggctttaccaatatgcaaatggctcttgcttcattgatgggacaggcgttccacttattaagcccattggttgcctttatctacttgctgttacgtttgactggattggatatgggtcaatggcaaaaagaatcagcaaaatatgcattgggaatctttgtcatctttatcgttaccattgtgttattaggtcatatgccgctttacattccacaataatattcaggattgatagggacgggtcgtcattgcggtctcgtccctatttttattagtaatacatgaggaaatcaaagaaaatcttgaaaaaaatttactagcatgttttattttcagaggtatcatgagaaatgaggaaaataaatgagtaatatagttgaagccgttaaaaaaaatcttgatttaacacaaaacaaaacattaaacgttctgatttatgaagcgtttcgaaaaaccatcatccttggtgatattccagcaggtactcgaatcaacgagaaagtctttgctgaagaattgaacattagtcgaactcctattcgcctggctatgaagcaattagtgaatgaaaaacttgtcgaacatattcctaaagctggaatcgtcgtcaaaggtattcgtatcaaagatgcctacgaaatttatgatatccgtaaatcattagataccctagcaacgatcaaagccatgaatcaaatgactgaagcagatttccaagaactgcaaacattattagaacaaggggaacaatataatgaggccgatgaaatagagctggttttaaaaaatttctctgatttcaacgcatttatctatgaaaaaagtcaaatgcctcgcttaaaatcaattgtcctagaactacaagcctatctcgtttattttcgcgacatcgctatccgttcgacgaaacgaagagataaagcattggaagaacactggctgatttttcgcgggatgaaaacaaaaaatgtcgaacaaatcacgctgatcacgcatgaacaccttgatcgatccttgcagtttattttggcggaaatggagcgtagacaaattgactgagtccctttcgaaccagattaccgactatgccttcaaagcattgttctatgaagtcagtctcagtcctaaacctggacttgtggatcccttgacaaccggtgcgcaccaagacatgaacttattcacatttatcgatagcacgatcagcttacgtccttattttcaacagtacctacatgcagggctgacacacaaaggaacccctagggagttgtttgataagcttagaaaaatcggagtagctgcagaaaaagccatgctgcgtgcaacacatgccatcaatacgcataaaggagccaatttttcttttgcagtcattttaggggcgactggctggtacttgcaagaaaaggcattgcctttaataaaagaagatagtgagaggattttgacttacacgcagcaaatgacaaaccacctactcgcagaagatttcaaagacttagagataaagacccagctcacttatggcgaaaagctttatctggaatacggaataaccggaattcgaggagaagccgcagcaggctaccctagtttgtcgcataaactactcccctttctacggacaactgttgatttcccaatggaggaacgtttattgcggggactgattttcttgatgagtgaaatcgaagatgggaatttattgcatcgcggtggtttatccgcttggcaaacagtgaaagaagaaagcaaaaaaattcaccaagccaccttctcaaaagaagaattgcttgatgaattacaaagctatgataggattttgactcaacgccacttaagtcctggaggttctgcagatctattggcattaggtatttattttgctcaactagaagagatcctttaaacaccatcgggcaaaaaggtatagcctaatccccatactgtcttgatatagcgagcttgctttggatcatcttcaatcttatttcttaaatgattgataaaaaccatgaccgtatttgcgtctagctcactgccgttccatacgctttgatagatttgttctttcgaaaaaacttgatccgggttttctataaaaaattgcatcaattttgtttccttggatgagagcttgattggttcttcctttttgtagagttggtagcgagacttgtcaaagcagaaatctccaatcatgattttgctctcttttgaaagggcacgatgctctttgataacttgccctctatcaagggtcactgttacttgtgctcttaataagttaggcaaaaatggcttggtaatataataatctccacccatttccaatccagtaatgatgtcttcttcatttttcttgccactgagaaaaatgatcgggacaagtggatcttcttcacgtataatctgagcaagatagtacccatcgttttcatgttctaaactaatgtccaataaaaataaatcaaattttacccgtgtcatgatatcgactgtcttttcaaccgaatcactttgataaatcaagattccggtcgattggagtgatttccatatcaatcgtcgtattgctggatcatcatcaacgacaagaattttttcgtttctcactttttttcctcctagttctttggatcaaattattaaagggagcgttttttatgaaaaagccttcaagcagattgcttgttctaggaatgatgaccgtcctctttttgactgtattaggaatggtcatcacagcaaacagctatcagcagacacaaaaacatgcgttaaaaatgggggagaatcaactagccaaaatcaatgactctgtaatcaaaatattgcgattggaaatcaaatcttacactttagcactggaagattatgcttcgaatatttttaatgaaaaaaattaccatgaactgatcgaagacactcagttggacaacagtctcctattcaagacctcggctgccgccggattatatcttgtttcaccaacgggcactctcctttctggcaaagacatccatgctgaccaatttgttaaagaacctgtcaaagtcacggcttttgatcaagatcccctttatctcaaagctttaaagggttcggttcttcaaaacggcgaagcttactttgctgatgatacgtcttatgtcaatttatatcgaccggtctatgacaagcatcatgtgcttcaatctatcttggttctgccaatcaatcttgaagagctatatcagcaagagattgacacaacagaaaaccaaaatggctatacgatggtcaaaaatgaagaaatgaaagtgctcatgcacccttccaccgaacaaatcggattagacatcatcaatgggcgaaagctgaaatatcctgacctcgactacagcgatttggctcatttagaagatgtccaaaagaccaatgaaaaaggaacattaagctacaattcttactggtggacagaagaagaccccaaaaaagttttaaaaatctcagcctatgaatggattacggttggggatgcacgctggatcgttgccagttcatcggacttttatgaacgaaatggactcgcactgcaaaaaaatctgatcatacttggcttactgaccattctcttagcaatcatcattcttttagcagtcagttttagtcattacaatcgccaaaaccggacctatatcgaaaatctgcgtttagttgaacggcaaaattttttgaaggaaaagcatgcccttgaaaaatcaatgatgcaaaaatcgcaattggaaacagtaggtctgctaaccactaccattgttcatgacatgaataattttcttactccgatgatcggaaatctgcaactgttgattgaagaataccagtcaaacgaagcgctcgttgctgatctaaatgaagtctaccaagcagcgcaaaaaggccaaaacctgtctacgaatgtattgcgctttactaagactggaatcaaaacgaaagaatccctctcgatcgaagaagtggtatcaggagccattgacaccatgcgcgtactcgtaccaaagaaagtcacattgtcctatcaagcttcttttgtgggcactgcactcattgaagccagtgacttacaagttattttatacaatttgatcaccaatgcttatcaggctcagccagaaaacccgcacatccaagtcagacttagtgcagcagcagataagcagttgacagcattccaaaaccattcacttgcttattgcgacaaacattttgcgcaacttaccgtgacagataatggtccagggatcccgaaagaaatagaaagtaaaatgttcacgccttttttcacaacgaagacagagtccaatggaactggtctcggcttattcatcgtctcatcgattgctaagaaaaacgattggatcttacaagtaaaaagcaccgtctatggaacgacctttacactagggattccagtagatagcggcaacgttcagtaatcgcttgcattacttatctaagccttttgttcgttcattcactatacctttattataacgaaaaagaatgaaggtttgacgaaaagtacaataaaaaaccagctattgtttgtcgtcatcagccgaaactcattttagtttgtcacggaaattccctcttgtttttctgcaatgaaaaaattacaggatagctcatcgcgtgattattagcgccagcttctgttctgcttttatgtcattaaagcccttctcaagggctttttttgttgcagctgtttttaattgccgcgatgattttacaaaaatcaaaagttttaaggtgtgttcgctttacaaaagagaacgtatgtttgtattatacaactagggaggcgtttttgatggggagatttaattatgaagaagaaccgttacgggatattttgttcattgatgtaaaatctttctatgcatctgtcgaatgtgtccagagagggctagatcctttgaccgccttgctagtagtcatgtctcattcagataacacaggaaacggattagtcttggcagcttcgccaatggcgaaaactgttctggggatcaccaatgtcactcgtgctgacaacttgcccaaccacccggatctatataaagtttcacctcgcatgaatctatatatcaaagaaaatttgaaagtcaacaacgtttatcggaactatgtggcggatgaagatctcttactctattcaattgatgagtcgctgatggatgtgacgcaaacgttacatttattttttcctgatccttctctttctagaagcgagaagcggcacaaaatggcagaaaaaatcaaagcccatgtcttcaaagcgaccggactgcgggtaactgtcgggatcggagataatcctcttcttgcaaaattggccctcgataccgaagcaaagaaaaatcccaccttcattgccgaatggacatatcaagatgtggaaagcaaagtatggggaatttcgcagatgactgatttttgggggattggttctcgaacccaaaaacgattgactcagttggggatcgaatcgatcaaagcattggctcatgctgatccagattttttgcgcagccgtatgggcatcattggggaacaattataccaccatgccaacgggatcgatcgaacgattttagcagaaccagccccaaagacaatggaaaaaagttatggcaataatcaagtcttaaatcgaaattattacttgcagagcgagatcgaattagttatcaaagaaatggcagaacaagtcgccgcccgaatccgccgtgaaggctgccaaacacaatgtatccatctctatattggaacagcttttggagagacacagaagggctttgcccaccaaatgaaaatccctgcgacagataacaccaaactattgattgctcacgcactgttcttatttcgcaaatactacacaggacaagtggttcgtcatgtggggatcacttattcgagactggtttttacccaaagcgttcagctcgatttgttccaagatccggaagaacaactaaaacagcgaaagcttgatttactgatcgataaaattcgcgccaaatatggatttacttcaatcgttcatgctgccagcaaattagaaggcggacgagcgattgcacgggcgaatctcgttggtggtcatgccggtggaatggatggtatctcaaacgaacctcaaggcaaagcagttcgtccaaaataggatggctgctaagcattttgctatacgcctatctcttttgctgataaattgaatctgtggaccagccggaattcacagcattgctaaaaaggaggaaacaccatgtgtgggagatatttatttgatccaaggacgggtgagctgtctgattattatcaagaactagtcacgatagctaaagaacaaaacaaaaaaatcgctgttgatgaagttttcccttccaaccaggtcgtcacgctgattgccgatgacacgcagcaaatcgtaccgatcctaacccattggggctttactggtttcaaaaaaggccaacttttaatcaatgcccgagcagaaaccgtagaagaaaaacgtactttcaagaagccatttctggaaaaacgctgtgcctttccaatgtctggcttttatgagtgggatagcgataagcacaagtttctctttgactcctcggagcccctctaccttgctggtttctatcggaaccattctactgccagcggttcggaagatgaatccattattttgacgaccaagcccaatgcaacgattgcaccaatccatgatcggatgcctgttttgttgtcgaaggcagatgttttgccttggatcacggatgtgactttcgcaagaaactatctactccaaacgatgcctgatattcacccacaacctgtttcgtaaaccaaaacgccgccagaagaatttgcttcttctgacggctttttttagcgagtgacggctttaataaacagtaaaggtccgtcctgtcatgataccaaaaactgatttttcataggcagcaaaaactttttcatccgcgacaggcagaaagccttggaatgagggagcataggtctcccaagagcctgccagcgcattcggactgaccgcattgatacgaatgccacgaccaatttctaacgccgctgaagcaacaaaagcaccgattgcgccattcaccaatgccgaagaagtacccatcggaataaactcgtcttgaatgatgcctgaggtcaacgtgatactgccgccctccgttaaataatgctgtccgatcaacactagattgacttggccttgcagcttgctgtcaatggagcgctgattttcttccggtgtcaactccgcaaaaggtttgaagacggtactacccgctgcggaaataatagcatctacagtaccgatctctgaaaacagcgtccgaatactttctggatcagcaatctccacccggtagtcccctgcacttcgactcgccctgataacctcaacagatttgtcttgtaaaccagccagcaaaattttccctaacgttccggtatgtcccactaaaagaactttcatccaatcatctcatttcgcttattttttctcattctacggcagattttttctttttacaaacgttagctgtccttttcctctttctcctctttctgtgcaggtaagtcttgatttaagaggattggataaagacagctattgtcaaattacgaaaaaagtttgaatgttttgtgaaacgccttccttgtaaaaggacttctatggtataactctaaaaaagaaggtgaagcttatgaaaaaagaagaactttgtacaagtaaatcctatttagcgaaagtaatcggacaacctaccttacaaaagatcaagatcgttcgcttactgagcaatacagcgactgtcgaacttttagaagggggcaactacggcgtagccaaactcagtgacatccagccattgaccgattagcggttagtaaagactgctctaaaaaagcgtcaagcaaacaaggaaattcctaggcttgacgcttcttctatcttattaaaaaagtgagtcttatccttgatgaatcagagttgctctgactgcatttggtacatttgctgatagattcccccagcttgtatcagactggcatgattgccccgttcaacgattctaccttgatctaaaactaggatttgctcagcttgcttaatcgttgataagcggtgagcgatcataaaagtggtccgtcctttttgcaagactgtcattgctttttgaatgattgactccgtttcggtatcaacgtgactcgttgcttcatctagaatcaagatttttggatcaaataccaaagcacgggcaaagctgatcaattgacgttcgccactggaaaactcattgcccttttctacgacgggatgatggatacctttcgggtaacgcgtcagcaggtaaccggcaccaactttttctaatgcggataggatcatctcttctgtgattgacggatcattcataccgatattgctggcaatcgttcctgtaaacagatagggatcttgcatcacgatcgccatcgaacgacgaacgctgtgacggtcgaatgcttcgatcacttgatcatcgatcgtgatagtccctgcttgagggtcataaaaacggaacagtaagttcaagatactggatttcccagatcctgtatgccctactaatgcgactgtttcacctgcagatacttgaaaatcaatctcgtgtaaaacagcttgctctgggtcatatccaaaggttacttgattgaaagaaacatttccttctttgatcgcaataactgcttcttgctgtttttcaattggctgatcagcaaactcgaagactcgtttgccagcagctagcgattgctgaacattggtgatcgtttggaccagaccttcgattgggtcatagagtcgattgatataatcaataaaggcataaagcaaacctgcggagatagcgagccgaccatccaagaagaatgccgataatgtcgtgatcagaatcaggatcgttgaattccgcaaaagattgcccaatccccaggcaatactcgaatccaataacagatactttcgacctgtctgaaaccatttctcgacggtttcattgaattctttctgcagttggccttctctctgaaaggcctgaataactgccattccttgaacaaattcatttaactgaccactgatttgagaaatatattcccgcatggcaatattataacgggaagcatacttcgtatagacatgttgccaaatacccagaatcggaatcagaataagcatagccaatcctagagtatgattcaggaaaaagagtgccaagaaagccccaatgatttgaatgatattgctcatcaaattactgatgacgatcacatagaaattggagcgcaaaacttccgtgtcattcgtgattcgcgcgactactttcccagcaggaatctgatcaaaataagaaacgggcaattggtgcatatggtcaaaaagctggtcccgcattttcttcacaatgcgatttgacattttacgcagctgcagcaagctgatataacgaaagagcgagccaatcaaattgatcagcaagtaacccgctaataattggatcaagaaaaggatattcaaattccctgtctcaaccgatggagtcatgacgccgtcaatcaatcgtttggcaatcagcggtgatgtcaattccagtgcagcacctagcagtagcaatactgcaccgatcgaaaattgttttttgtaatagcctacataagacagcaggcgcttaatcgttgagaacatcttgatcgtcctcctttaactgttgatgataatattgctcttggtaccatccaggaactgcgatcagctcctgatgggtccctctttggataacatgcccctcttccaaaacaatcacttgatcggcgtccgtgatggcggataagcggtgggtcacgatgatcgaagtcggtgcatctgtcattgctttaaggtttgcgatgatcgtttgctctgtttttgcatcgacagctgacaaagcatcatccagcaacagtacatcactccttcgcagaaaggcccgtgctagcgacaaacgttgcttttgaccccctgataaagaaactcccttttcaccgactaatgtttcaaggccttctggcatccgtttgatgtcttcagcgaaacatgcgagtgataacgcttgccataagcgttcttcggatgcgtctgggtccccgaacaataggttttcgcgaatcgttcgtgaaaacaacgtatgctcttgcggaacttccgcaaagtgacgacgaatctcttctgtctgaaaagcagtcaaaggctgcccattgatcattggcatttgatttgaatacgggtaccgatgtccgaactgacgtagcaaggaagtcttaccactacctgttttgccgacgatccccaacacttctcctttggtaatagtcagatcaacgtcttgtaagacaaatcgttccgtattcggatatttgaaactgtactcagagaattcaattgtttggatcatcggtacaagttgttgtcctgtagattctagctgatcgccagtctgcaatacttcattgatccgacgccaagaagcagccccttgctgcatcacatttaccagatctcctgctgaaatcatcggccaaaccaccatcgttagatagacttggaaagataccatcgcaccaatagtgatttgttgattggctactaggaaagccccgatcccgaaactcatcacaaaactaatcgccaaaataattgtaatcagcggcccaaaacgggaatcaatctcggaaacgatgtcgtttttttcacgagtttctgttgttttttgctgaaattgctgcgtcgttgctgcttctaagccgaatgcccgtaccactcggataccatcgatgatctccaacacttcactattcatctctgaaacagagttttgtgcttctgtaaaagctttatctacttgcgaaccccatttgaaaatgtagtacgccaagaggggcataggaatcagtgcaatgattgtcaatacccaagagactgtaatcgccatcatggcaacgatgaaactcaaatagagactcgtattcaagaaaaccatcaacccatagcctacggtcattcccatgacttgaacatcgtcactagaacgagtcattaagtctcccgttcgaaaccgatgataaaagggagcccccatgtttaagaaatgcttcatcaattgctgacgcaattgcttttgcaaatcgtatgatccgataaataaattaaatgtccaaataaattctgcaatatagcctaaaagtatcgcaccggcaaacaagctgacatagcgaatcaaaattgccatcgtaaagtcatcttgaatcagtgcatcaatgaataagcgcaaaatatagatcggtgctacatacatcgcactggcaataaccataaaaataaatacgattgcataacgcaatttatgcgctttaaaatacgtcgttaattgttgtaaaatatatttcattttcttccctctcaatctaaaaaagtacacaaaaaagctctgccctttcggaaaaaggacagagcataacgtcaaaaaatatcgacactatctgtgtactaacggattaccgaataagggattaactactattttgttgtttgcgaattttgctgtaacgttttgcatcgtaatccctccttctttttttatttgctgactacaagtaacactttacagataactatgagaatttgcaagaatttttattaattttttttaaaacgattgactttcttatagtccttttcatcacttaatgataaaaaaagaccctttattcttttcccattctgaaagaattcttcttgttcttttttctcttttgtcttgataatccttagtctgtcaagacaaaggacgccattatttggcacaaaaaaaagttttttataatccgcccacaaagaaatctgcttccaaaaaaagacttcctgcatgggaagtcttttcttaaaaaagtttcgtttttcaacactttgttctttactattttaataatcgacaaactattactcgtttgaacaggcttatgaaggtcattttcgtctcttttttgccgcgctttttttgaaataggatgtccgataccagttcagaagatgaagaaatggggaacatccttttaggtcttaaataaaatgttcatccttcaaaaattccaatacttgatttttcaatgtatccgtatcagaagcttcctgacgacggttaggtgagaccgcaggctgagcgatcgattcgacggtttcttgtagagattctggcggcaattccagcaattggaaactatctactacaacttcggcaccatagacagattgtccttccttggtttcaaaaggacacatatgcaaatgtccattgattttaacacttgcacctttctgggtataccgcaaaaaagtttctgcttgcttgccgttgataacacaagcaaaccattctgtttgcaactgttcgcttgtttgccactgtgcagcgactgctaaattaaaccgtacacacgtattatttgctgctgcagaagccagttgttctcgactgggcatctcattaattttcccagtaaggatcaccttgttcgttgccacgttactccctcactctacattttatttagactcgcactaatgcaagattagccatagtctatcacaaaaaaaatttcttgcaattcttttgagaacatctatagtgatcttctacagtttttgtcgctgacttttaaacaaaatttaaccgagcttagccttcatcagtcgttgaatctatttcagagacatacgtccacgtcatgccattgtcttctgaggtaaatacgcctttgactgttccacctttgtaatcccccatgggaccttgattgaccataactttcaactttccatcttctagataaggtgcttcagcaaccacgaaaaccttcttccattcatcaggcatttcaaaagcagcttccagccacgtgtttcctccgtctgtcgtcacatagagacttggttctgttggcgttactccgccgaaactcataaagccaacattctcgttgaggtagcacgcgtccgtcaagagtcggctgattcccttagccacttgcttttcctgccaagtcttgccaccatcttgggtcacatatgagagatagccttcctgccccattacgcggccacccgataagaaaatgtaaccaaaaccgtcttggccaaatgtcaatttgcgaaaacgtacagctgctgtctgctctgccagagcaacattcttccacgtatttccttgattttccgtataagtataatagacattttgagttggactgccctcactagcatattccgttcggataaatccagtccgttcaggagtcaaaatatagctgccagcgatcagcgcttgtttgtcgccactatactcgccgccaaaaaaatcatctaacggatagggcagaatgatttgatgtttccagctatcataagttaatttcaattgactcttaccaatttctgttttatacgcaatcgtctgattcgtttcctttgaggtggtcatttgattgttcttatcggtgatcgcacttagatctcccgcatctacattcgtgatcgctttgtccccttgagcagtcgtagcaaccttaacttgccaacaaatgtcccgcacagaaccgtcatcggaaactttcccccaataagatgtcatcgtctcacgattgatcgacttgggccacacagtaaattttaccgtcagcagcccatcttgataggttgcaccactcacactgtaagaatcgatccgtacatcttcttgcaccttcacagaagaaaaatagcgcatcaaatcataaaataaattaaatccttgtgtattcggatcatagttaaattcgctttcaaagggcagaaattgattaaaataagtaacgggctgttctttgatagcggattggtttacttgagaagtctctacagttgatgattttgaaccactcgaactgaccgctcgtcctacagaaaagccaatgatgaaccagatgactagcccaatcacaatcagtgtcaaaccgacagctaacgctacccgaattgctgctatttttttatgctctttcacgggaaaaacccaccttttgttttcaattacttgaagtataatgaaaagtttcttttctcacaagatgctttttcacttcttaagaaattaagaaaagggttcctcattaaatagtttttagaaaaaataaaagcattcgcaaaaaagtgacatacttcaggctttccaaagatggaaaaactgaagtatgtcatttctaaccattctactgtttctttcatatttattcttatattgcttctctggtttcttcacacacgttgattaatggatcagattattccttcagataccttctaaacatctcctatcatctaataaatatgtgcgaacttgcgatacaaaatataatgaaccagtaataaaaagagtatctttcgatcccattttagcaacaatctccttaataccttgttgccactcttgataatatttaaattggctattttctcgaacaagatcttcttttttcaacgctttcgggtaatcgaatgtggttattataaggcaattattagggatttgctgcatctgtcggatcattttcctactatttttggttgttagcgctgaaaacaaaatatatttctttccttgttgaaatttttctgtaactgtatcaacaaattcttttatggcatgtggattgtgtgccccatcgataatgatcgtcggttgtgaactgattttctccatacgacctggccatcgcgctttttctaaagctttctgtatgctctctttttgtatcgctttgttttgctgctgacaataaagcaaaaaaagttgaagggcagttgctgcattttccacttggtattttccacataaaggaattctaagatttaaaaattgaaagtcttcattttcgaagtgaaacatttctccacttatagaatccttaggactatgactttcagggctttgcttcacatagtgaacttggtaagaggtatttttcttagagagtggcgcattttttttagaagcgacttcttcaattattttcactgcattttgcgaaatgtttcctgtaacaataggtatgttttttttgataatgccagctttttgcaaggcaatttcttcctcagtttcgcctaatatatctgtatgatctaatccaatcgtagtaatagcagttaaaattggtataaaaacattcgtactgtcccattttcccccgatacctgcctcgaaaattgcgatgtctgcgtgcttttgaaaataagaaaaggccattgcagtcaatatctcaaattctgttattccctgatagcgtgtatcctcatccatactatctaccagagggcgaaattcatttgctagctggacaaattcttctgcggagattgctttcccattaatcgaaatacgttcataaaaactttcaatgtacggcgaagtaaatgtacccactgctagcttctgcatttctaataaacaacgcaagtaagttaccgtcgaaccttttccatttgttcctgcaatgtgaatcccgatactattcttttcgggatgaccgcacagcttcagtagctcgttgactcgtatcaaaccaggccgcgatccaaattttttgcgcgaatgaatccagcgtactgcttcatctcctgttttaaacattcttatcatccccaatagaattgttagttcgtttagaaaatattacgagcgaagcgtttcaaaggaatcgcatgaccaaagaatacgatcatggctgtttgtacaggtagcatgatcaccgctttgacaatacgtattccccaaagtttcgtatcggtcaaaggaattgcatacatcattgacaaccaaattggtgtcagacacaaactgataattaatgtattgcaaagaacacatagaaaagaattttttattgtaatgggctttttataaaaaaagtagccataaagcaaacctgcaatgaatgaattcagtgtaaagccaatgaaaaaaggagctttccctaaaagagtattcccgataatatcagcaattgaagcaccaattgctgtccaccaagggccaaataaactagccataaccacttctggaacaaaatcaaaggtaattttcaacagctgggtttcaaactctaatacttgagacaaaacgaccattaatccaatcagtaatcccattgttgcgataatatgtgcgtctatttttttcttcattcttagcatctcctttaatagagctgctacacaattaatttatgcagcgaatgcaaagatagaatcgtgaaatttgtttcttcgtctaaaaggcaacatcccatccttatagcacttaacgctctatcttctactctgtttttttatttttgtcaaaacagcaatcctgttgtttgcaagattctgtttctctgatgaactagattccacttgtataaatgtttcatcttttataaccagcatttcatttttttgcaacatttgtcgctgtgtcctatcgcccagaagcactattgaaagattctccaatgcataaatgacagcaatagtctgcggtttaataaaatgcatctcatttcctttaagcgcctgaacaaagacgtcgtaatcgtctttaaaaataacattaaaatcttgacactcaccctgacacgttgtttttaatttaccatcgaaatggtggggctcaaaagcatttaggctaatccaagaacctaattgccctaatctaactggattatccaaagacataaggattcgttgataaccagtaaagtcagaaaattccacggtattcataatcactgtcgcagttgagagacggaaatcaaaatctcgtttagctaagctacttgaatcaggttccactaaaagttctgtagtctggcctccagaccactttgtggacaagtaatcttcacatgttttcttctcgattgttcccacacttcttccttaaacaatatctaattcttcaaattgactcaaaattttaatatcttgtgccacactgacaaaagccttttgatcaacatctttcatgatttgatccaaaatttccatttcgtaagtagtaataaccaaaatcagaatcgtttgagtttcttgattatatgcgcctagtgcatatggaatgatcgtgattccacgacttaatttttcttgcagagctgggataacttcattcggcttttgcgtaataatcgtcacctgaacttttttatgtttgacatacactagatctgtaacttttccacttataaaaatggataaaacactataaaaagcatagggccagccaaataaataaccggctaccaatacaatgactccattcaaaacaatcgaaatcacgccaatgcttcgaccggtgatttgtctgattgtaagaatgagcgcatccataccaccagttgaaagtccatattttaatgccagccccaaagaaaagccattgattgttcccccaaaaatggcgcaaataatcggatctgtagttagctcagtacttgggacgatgtggatggcaaatgatgcaaccgttacacaaataaccgtatagatgacaaacttgcgattaattttgaaccatgcaagcataaacattggaacattcaggagataatatataactgaaatagggacttcaatatggcttttagcaagaccagtcgcaatgatttgtgcgatcccagttaagccgccggcataaatattccctggctgccaaaaaagattcagcgccaaggaatataaaaaggcataaataagaatcactgttaattttgtaaccacctcttgccagatatctattcttttaaaacgtgacataatcctctttccttttctttaaataaaaggaagacatctcttcctctgatatcggtcaatcggcacaaatcaggtcatacctttaaaactgcagatccaatgtcacttgtttctcaatttcttttaagaaatctctatcttctaaaacggtagttgctttgtttaattcatcatacatttcgatgtctttatcatgctcaataaagtttacttgtcgacgaaatgcaagataagctgcttttgtgcctttgccaagtcctgactgatatcctttgatgtctagtgcttggcaagccgccatgatttcagttgcaacgacccgccgagaatttttgacgatttctagagctgttcgggcagcagttgtacccatgctaacaaagtcttcttgattttcacaggatggtattgaatctacactagctgggtgtgccaagattttattttctgaaaccagagatgcacatgcatattgtgtgatcataaaaccagagttcaaccccggatgtttcaccaagaacgaaggcagattacttaattggtgattcaccaatcgttctactcttcgttcagatacattgccaatctcagcggcagcaatacccaaaaaatcaaatggttgcgccaaaggttctccatgaaaattccctccggaaatcacttcaccatttctagaaatgattggattatcagtaactgaattaatctcaatttctactttttcttttacatatgcaatcgaatctttactagcaccatgaatttgcggcatacaacgtaatgtgtaaggatcttgaacatgatctggtgtcgcttccgtaatatatttactatcttcaattaaacgacgaatattacgagcggttgctaattgcccactttgcgggcgaatcgtatgaaggtcttctttaaaaggactagaaattccgtcatgaacttccaatgagagtgctcctgcaacatctgaaagttttaataactgaatagcatcatacgttgccaatgccccaaccgcgttcaaaactgttgtcccattgataaaagctaatccttctttggcacttaattgaatcattttcaatcctgctttttccattgcttctttcccagaatacaacgtgcccttataataagccttacctaaacctagtaatggtaaaaccatatgagctaatggggctagatcaccggatgctcctaatgagcctttctctggaatgtagggatggacacctacgttcaacatcgctaacaatgcttctacagtgcttaaacgaataccagaatagcctttaatcaacgaattaattcgaatcagcataatagctcgtacaatatcttccgaaaatggctcgccgtaaccagcagaatgagtacgaatcaaattttcttgtaattgcacagtgtcttcttttgaaatactgacattacaaagagaaccaaatcccgtattgactccataaacaacacgacgttcctctacaattttatcaacaatcctgcgcgactctttcactgcttctttggcactttcggctattacacattgacgatggttgcgtgctacagccactacgtcttctaaagttaggctagcaccatccaaaataatcatttcttgactaggaatggtattctgagcttcttcttttatcaacattttcatcgttttattccccacttttctaataaattccttccaagtatcagtttccacaagttttctaatttacttgcttcgatttattattgtttaagagtagatacaagatgcttgctactataactccaataactccagctattaaattgatcggattggccgcagcgaccatccaaatactaacaactatggagataattggaatgactggaccaaacggcagccggaaagcaggcacattttccatgtctttttttctcaaccaaataactgccaatgcagtcggaatgtactggaagaaacgaaagactacggacagttccgctaattgttcaaatgatccgcttagtagaaaagctatggttagtaaaccagaaaaaataatagcaacgataggtgcatttttattattttttttagcaatcaccttaggtaacaatccttcatccgcgattgaagctccatatcgcggaatcatcagagaatctcccatattcaagccagcaattgaaatcaaggccccgattgaaataatccatttcccagctggtccaatcatttcaacaaaagcatcttgaactggcgcattgctttgtaaaattcccgttccaagcatggcaatcgttcccgcaataatcataaaataaagcagcgaaacaatacttatggatccaataatcgcttttggcacattttttttggcattccgcatttctccagctactacaggtaaagcttcaaaaccaataaaagcataaaagacagtgagtgacgttgaggccatggctttagataaagtcatgtcaggattcaattgtagaaacggtgtaaagtttccttgattgattccatttttgatgaaaaaaactgcaatcagtgtgaaggcaataattggaatcaatttagctattgtaataacaatcgtaaaaatttttgaagtcttaatccccatactattaatcacagataagaaaataaccaaacaaatgctaatcaatgtattctgtccttctaacgctggaaaagtttggatcagaagtttcgcaaaacctgcagccattgcagcccacgcaataatcgtcacaaaccaccccagaacaccaacattaaatccaataaaatcgccaaatgctgttttcgaatattggaaagctccgccattcttattgaagtaacccgcaacttcggcgaagcaaacggccaacatcaaaaccaaaaccgcatctaaaaccattgcaacaagagaagcaggacctaaatcttggtaaatggttcggggcaaaagaaaaattcctgaaccaattactgcattgattccgtatagcgtcgcaccaccaaagctaaattttgcattctcatttttcgctagctctgcggagtcaatgtctttaatatccgttatctctgaaacctcgacatctttttgcatactatttcacctcttctttttttattgtaaaacgttttcaattacacgttttattctagtaagcagttcatgttagctattttacaaagagagttccctccacctccttgtaaaatagctctaaactgctagaataatccggttatatttcctttttcatcaatatcaattctttcagctgctggagattttggtaatcccggcatcgtcataacagctcctgtcaacgcaacaataaatcctgccccggcagatactttgagattacggatcatcacagtaaaatattttggcgctccaagtagtgacgcatcatctgaaaatgagtattgggtttttgccatacaaattggataattaccaaatccaagacgttccaattcctttaattcttttttcgcacttggtgccaattctacgcctgccccaccgtatactttttggacgattttatttagtttttcttcaattgaatcatccaaatcatagacatagctaaaatgatttggctcttctgctagtgcaactactttttccgccagctctttaccgccagcacttcctttcccccaaacatcagatagaacaactgcaacgtccatttctttacaagctttctctaccgcagctaattctgcatctgtatctgttggaaatttgttaatagctacaacaactggcatcccgtatacttctttaatattctctaagtgtttagacaagttaggtattccagcaaatactgcatcgacattttctattcctaaatcgcttttcttcacgccaccgtgcatttttaacgcacgaatcgttgctaccaaaacaaccgcatctggtcgtagattagctaaacgacatttgatatctataaatttctcagctcccaagtcagcgccaaagccggcctctgtcactgcataatcggcatactttagcgcaagtttcgttgccaatacgctgttgcatccatgtgcgatatttgcaaatggacctccgtgaataaaagcaggggcatgctccaatgtctgtacaatatttggctgaattgcctcttttaatagggcggccattgccccttctgctttcaaatccccagcagttaccggctccccatcgtaattatatgcaacgatgatttttctcagcttattttttaagtcagcaatatcgttagctaagcatagaatggccataatttctgatgcaactgtaatgtcatacccatcctcacgtggcacgccatttactcgtccttgaagaccatttacaatgtgacgcaattggcgatcattcatatctaccacacgtttccaagtaattctgcgagaatcaatttggagaaggttcccctgatgaatatgattatctaatagtgccgctaataaattattggcggcactaattgcatgaaaatcaccggtaaaatgtaagttgatgtcctccattgggactacttgagcatgtccaccaccagcagcaccacctttcacaccaaatacaggacctaatgaaggctcgcgtaatgcaatcactgcttttttcccaatggctgtcaatgcatcgacgagacctactgaagtagtggtttttccttctccagcaggtgtaggcgtaattgcggtcactagaatgagcttgccatcctcgttgtcatccaatgactcaatattattgatctttgctttatattttccataaagagacagattttctttagcaataccaattgattcagcaatttcttcaatcggcttcatcacaacagaatttgcaatttcaatatctgataagaccatgtccataaacttcctttctatctaccaatctaaatgattacagcgattcaagtatttgttgataggttgcatcagcaattttgctgccttcctcaactagcgattccccggctttgcggtattggcgaacaaacatttcgtctttgatgcttgcaaggttaatcaatacattcaaccacgcaccttgtaaagctgcctttaaattcaaagcagctactcccaaatcactagcagcattggtatttgatttgccaaccgcagcctgtgtgacttttaacgcatccacaattttttccatcatagaaaaaggtgtaacagctgctccttttaaagcactctgcattgcttctcggcgggcttttttttcttcttcggttgtttttgggagtccaaaaacagctgacacttgattaaaagcttctgtatcttcatcaattgccctgagtaaaccctcttgcaaagatttagcttttttttgcagtaattcaatttcgtcttcgaactctgcatatttttttttgccaatcgtgagttctgtcaccatctttgtcaaagcaattccttgtgcggcagctaatgctgaagcagatcccccacctggtgccggtgtatccgaacctaaaacagcaatgaaatcgtttatttgcatctcaacgagtttcatgacaatccccctatcaattcaataaatgattttcgaaaacttgcttattataattgaactcttcaatctgtaaataatattcagcacaatcaatcaaggcttttgctggcgttaatccgattacttcactgccaataaccgacacaccataacgttttgcttcaaagcgaatcgtttcaaacacacgatacagcggtgttttctcgaagttcaccatattcatagatacttgagcaatattacgatcttcaagcatgacaccaatacccttgcagtatttccatcctccagaggatccgcgaacaattttagcgattttattggcaatctcaatattatctgtatccaaattcacattgaatgcaactaaaggcattctggcacccactgctgtgacaccagcggttggatgaattttgcgttcgccataatctggttgccattcttcttccaaaagtttttctggcattttctcaaattgtcctttgcggatcttcgctaaatttttacgtacgggtgtagtggctgaatcttcatatagaaaaatgggaatctgtaattcttcattgattcgttgagctactttcttagaaatagcaatgcactcttccatggtgacatctttgatcggcacaaaaggaaccacatctgttgcccccatacgaggatgttctccttgatgcttcgtcatatcaatattctcacttgcaaacttcactaattgaaatactacttcttggattccttcttcatcaccaacgagtgtaaaaacactacgattatgagatgtgtcagaagaatgatccaacaatgtgacacctttaacattcttagcgatctccaccaacccatcaataaccttttgatttcttccatcactgaagttcggaatacattcaattaattttgtcatggtctattgctccttgtttttattttgaactttaggtacggcataaatttgttcttactacattaaaaaaaatctatgaatagcgttatttttatttcaacacctcctaatatcccaatttatttgttaccgctttcattcaccgaaatcagcttatcactctttcaaatcggttgcaaactccgtaaaaaaaagcttttcataattttttcataattaaaattctgtttttttttggaaaattctcctaattgtcttccgcatttttttgtcttttattttatttgacctttttttgactttcttttttaaactgaaggtaacctatcgttgcgcattgaataaaaaacaagacagactttatttaatctttttgatttcttttacaaagtactttttttgcttgaataggtacactcataaacaaaaatttgtaatcaacacataaaaaatcttcaagttttatttttgacgtttaatagtcggtgcccttcgttttttatacataaacattagaaaaaaataattattatgccgataattcttttgaacttttggaaaattatcagcaaataaagaggtggaaacatgaagaaaattgttttgttgattgattttggcagcacatatacaaaattaactctggtcgatcctagcgccatggaagtccttcatacagctcagattcccacaagtagtcaagacgggttacagttgtgctatacagaagggaaaaaagcattacttcaaacgttaaaattttctgatcaagtaaagatagaagaatatttctgttcttccgcatggggaggctttaaaatgattgccattggtttaactgagagtttgacattagaagcggcgaaaagagcggctctgggggcaggcagtcgtattcttcaaactttttgttatcgtttgacactggaccagcttgaggaaatagaacaacaaaagccagatgttgttttgttgacaggagggtgtaatggtggaaatcaagaaatcatccgtcacaatgcccgtcttcttactcagctttctacagagattgcattgattgtagctggcaacgaagacagctatggagaattatctaagctcttgcaagatcgaaataatacttactttaccgaaaacgtgatgcctgatgttaataagctgaatcctattccggttagaaaaattgcccaaaaagttttcttagaaaaaattgttcattcaaaagggattcatcaagttgcagctcacgcaagtgcccccatcatccccacccctaaagctgtattagctgcagccaagctattaaaagaagggacacaagcttcgaaaggttttgggaatttagtcgttgttgacattgggggagcgacaacagatattcattctgttggagatggtttaccccaagcagaaaatgtttactttgaaggattggaagaaccctatttgaaacgtaccgtagaaggtgatctcggtatgcgttcttctgcagtaagcttgctaaggtgcattgtagaagattccaatcgaatcagggcattgtcttcttggaaatttacgactcttcaagctgcttgctattatagatgtagtcatccaacatatgtaccaaagacacgagaagaatgcctaattgatcaatttttagctcaatcggcaacggctatcgctttagagagacatgctggaaagataagaaaagaatatacgccaaatcgtacaatctactaccagcatggaaaagatcttcgaaatttccaaacaatcattggtactggtggcgttatcattcatagtcaatctcctaaaaaaatagttaaacctgacatcaagggcatgtctaatactttgctaccagtagatccgcaaattcttattgaccaagactaccttttatctgcaatgggacttttaagtcaaaactatcccgaagcagcattgaacattctaaagaagaaactttatcgactcaacccttagttgtgaaaagaagctgtgacaaaagttttgtcacagcttcttctgaataagcggttagtaatagctttttcggaattttcttctcatttcttgaaactgatcacatctgtcacagcctcagatatcaatcttatagatttacatgaaagaattcttttaaaacttgcaactcatagcggtctcgatattgactaaggttgtccattgcttttgtcaaatagtacgataaatcttctttaaccaaatgatttaattgtagatttgcatgcctctcatttagacacttttcttttaccagtgctttgataaaataaacgagaccactatcacgcggattagctagttgattttggtaacagcttgtcttttcaataaactctatcacttttccataatcttttttgtgaaggtaaattaatgttaaataagcatttaactgaacccttttccataatgaagtagtaacttcaaaatattcatttgccttgagaaaataggtttccgcttgatcataatctttttttgcatacagtgtaattcccatatcaacataaaaaatagccaagctcgtcaccaaattatttccttcacacaaattgatggctttttgttgcagtttgatagactgctcatagttagaccgcaaacgctggatttctgctagataatcatacgcggcagcaatattgctgttatacttttcgtcaaaacggttggcaatattaaaaattgtaatcgattcttggatgtacgattctgcttgatccaaatcaccgatcatcagatgatacaaacctttcaatcgcaataaaataccgatagattcgttgttattggcagtaattgctacatccattgccaaatcgatataatgtgccatgtccgtcgcattatcagtttgaatatagtaataaatcatttgacgatacccgcgcaataaataggttgttagatgaaagtctttcgcttttacgattactcgctgaatgttttcaattcctcgattatagtccccggaattgatgaaaaagcgaccttctagataaagaaatctgacgagcaacaactgataagtactatcttctgcatactgtccttcaatttctttaagtcttgcacctatctctttgaatttttctaattcatttggggcttctcttctgaccaattcacgtgatgccaaatgttcttgatgatagattggaaagagttcatgttgaatacgtaaaaataattgatgatgagaaagttcataatctaaggacttaagttcttgatgcgcctgacgatagtgatacccgattgctgccaataattcgctatcgttttttgcttcatttaacttttgctctaataaaacagcaattttttcatgtatcacacgtaatttcatatctgattgttgtgcataaataaattgtttcatcttattatgtttaaaactaaagcatacttcatcgagataaatattctcattgatcaatccttgcttgattaaattatcgagcgctttataaacctctgctttttgaccatcgactaactcaattagtacactcataaatgctaatttctgaaagaaagaaatcaagtcaatcaattccacttctacaggcaataagtttacaaactgtagactaagcttatcctttatgttttgcgttaatctttccaatgtgttgctctcttccaattgatttaagtactcactaatgtacagaggaacaccttctgattctctcataataaaatctattgtagatgtttggaacgtatgattaggcaattgtttctcacaaaaagccctgacctcaaaatcttgaaatggaagtaatttcaatgtgataattttttcatagcggcgaacgcttacgataaagtcttgtatttccttgcgaaagcttgattgcaatgtcatgataaaaatgatatcccgatgggggttatgcagaattaaactcgttaatagcctaatactggttcgatccatccattgtaagttttcaataaaaatgacaacaggagttattttccccaactgttgcaaagcttccgatatgcattgtgctaaaaaatttaactcaacagaatcaatggaccgaagtacgcgttgtgctattaaatcattaaaaaatggaaattgttgactaaatgtttgttgccattgactaacttcagctagcttttctctttgcaataaatggatgatctgttgcagtagttcacgccatggacgcaagcaatgctcttgttccgttttataacaagtcactttgaatagctcataaggatattgaatattttctatgactaattgacacaatgaagactttcccacacctaaatctccagtaactaagaccgattgaaatggctttttttgttttaaattcgccaaattcaactccaagcgctccacttcattggatcgaccataaaagtgattcgcgcgttttttttgacttactcgctgtttttgattggcaatctgtaatgttctttgatagagctgttttgtttcttcacttggttcaattcctaattcatctctaagtgtctctaccaattcataataggtttcaattgctttcccattgcgatgattttcaatataaaattgcatcaataattgataattgcgctcatcaaattcatcaattgcaattaattttctgatatttttttctacatcggctacggcatgaaatgaaatgtcttctgcaaccttttgatagcagcattcaataaattgatgttcatagagattacgcatcttagtcaaccatgcatcaaacagatcggaatctttcaaataaaatccttttaaaaattcatcccgatagtcttccagatgagcataagcatccttttcaaaacgatacgtatcactctcaatgattaaatcagaattaaacgtcaaaatagatttattcggtgaaacaataaattcccctcccaacgagcgatttgcttgataaattgtatttcgcaaattcttcttggcacttttttcatctttactaggccataaaatacctgctatttcatcccgactaatttgtttgttgatcaccatgtaatacagcaaagcattgatttttgaaaaagaaaaaatttttatgttcccatccacttttattgttggtgttcctaataatttaaacgacaatgtatgctccatcactgctccttctttcagttttactaatctttattttaaaacaaccaacctaataaagataccgcttacaacactgtccattataaccttctaaaccttctaaaccttttataagaaaaactctctaactctatcactagaattggagagttctctgcaaaaagatttctaactatgctgacgttgcgagacgacaagatctccagccttatatacatgtgtaaccaaattagtcgcaaaaaaatacaatggaaaatcgatattcggtgcatcaaaaatagtaatatctgccgattttcctttgtctaggcttcctacgctctttgatcgacaaatagaatacgcagcattaatcgtaaccgcattaaagacttgaattggagtaagcttttgcataaagcaacctaactgcataataaactgtaaatttgctgttggacaacttccagggttactatctgtcgttaatgtaattgccatacccttgtcgatcatttttcttgctggtgcatacgtgtcttccattaagctaaaggtggttccaggcagcaaattcccgataactttggcttcgctcaactttctgattccttcgtcagttatcatcattaagtgttcagcactaactgcacctaactgtgcagcaatatctactcccccaatcgatgcaatctcgtccgcgtgtatacgtaatttaaatcccatttcttttgcggcttttaacaatcgataagattcttcggcagagaaaaccccttcttcacaaaacacatcacaaaattctgctagtttttctgcttttacttttgggagcatttcatcaatgattaaatcaataaactcattagaacgtccctgatactctgctggaatcgcatgagctcccataaaagtagaaacaatatcgattgcatgttcgttattcaatttttttgcaacttccaattgttttttttctgtttcccaattcaatccatagccgcttttagcctctactgttgtcacaccatgcatcagcattttatccagcagatctgcagatttattatacagcgtgtcaaatgaagcttgtctagtcgcattcattgtacttaaaatcccaccaccatcagctaaaatctctaagtaaggcacaccatttaatttcttggcaaactcatgctctcggctaccaccatatacgaggtgtgtgtgacaatcaattaatccaggtgtcgctagtttccctgtgtaatcaataatttccgtatgtttatcaaccaaatcattgtttggctgtccttcccctacgtgcaaaatctttccatccttgatagcgatatagcctccgttgatgattatcgcttcactcatctgctttcctctcaatggtgcaccctgatcaatcggacaaaaaatttgactaaaattgtttaaaattttttctgctttcattattcttactcctctacaaattattcatattctgagtataaaaaatcatagtctaacagaagtcaaacgatgcgtctcaaccatttataaaattggaataaaattatttgtgcggatagacgtttcgttgacaccgcttatatatactgagaatcgtaagccgattaagaatattttattcattcaccattattatacacttgaggaggaaatattaatgattcaattacaagacatcgaacaagcgatgacagttaagttagatgactttttacctgaaaaaactatttttcaagaaggcattcgccgcgcacctgatcgcggattccgtttaacaaaagaccagacagaactcgcattaaaaaatgcattgcgttacattcatccaaaatatcatgaaatcgtgattccagaatttatagaagagttaaagacacgtgggcgtatttacggttatcggtggtatcctaaggaaagaatctatggcaaaccaattgatgcatataaaggtaaatgtactgccgcaaaagcaatgcaggtaatgattgataataaccttgattttgctgtggcgctttatccctacgaacttgtaacttatggagaaactggtcaggtttgttccaactggatgcagtatcacttgattaaaaaatatctcgaaatcatgacagaggaacaaacattggtgattgaatcaggtcaccctttgggccttttcaaatcaaaaaaagacgctccccgtgtgattatcacgaatggattattagttggggaatacgataatattgatgactgggaaattgccgaagaaatgggagtaaccaattatggacaaatgaccgctggcggctggatgtacattggtcctcaaggaatcgttcatggcacgttcaatacccttttgaatgctggtcgtttgaaacttggaattaaagatgatggcgatttagctggaaaactgtttgtttcctctggacttggtgggatgtctggcgctcagggtaaggctggagaaatcgccaatgcagtggcaattattgctgaagtggataagtcacgaatcgatacaagattagaacaaggatggatttctaatcttgcggaaactccagaagaagcaataaacattgctacaagctatctaaataaaaatgaaaagacttcaattgcctatcacggcaatattgtcgatttattggaatacattgaccaaaatgatgtaccagttgatttactatctgatcaaacctcttgtcataatgtgtacaatggaggatactgccctgctggcattacgtttgaagaaagaacaaaactattagccacaaatagtgaaaaattccatcagctagtggatgaaacattgaaacgccattaccatgtaatcaagtcgcttgttgcaaaaggcacctatttctttgactatggtaactctttcatgaaagcaatctatgattctggcattaaagaaatctcaaaaaatgggattgatgataaggatggcttcatttggccatcttatgttgaagatatcatgggaccaatgcttttcgattatggctacggtccatttcgttgggtgtgcttaagcggtaaacacgaagacttggtcgcaacagatcatgctgcaatggaagtgattgatccgactcgccgttatcaagaccgagacaattacaactggattcgtgatgcagaaaaaaatcaattagtcgttggtacacaagctcgaatcttataccaagactgtatggggcgagtgaatattgcacttaaatttaatgaattggttcgagaaggtaaaattggtcctgttatgctaggacgtgatcaccatgatgtttctggaacagattctccattccgtgaaacatcaaatattaaagatggaagtaatgtttgtgccgatatggctacacaatgctacgccggaaatgcagctagggggatgtctttgattgcactgcataacggtggtggtgtcggaattggcaaatcaatcaatggcggttttggacttgtactagatggttcagaacaagtggacgagatcatcaagtcagcgattgcctgggatacgatgggcggagtggcacgtagaagctgggctcgaaatgatcacgcaattgaaacgtccattgaatataacaaaatgaatcaagggactgatcatatcactatcccttatcttgcagaacaaagcagcatcgatgccgcaatcaatgcgctttttgattaaatcaaacacggattattttttcccaggaactgtgatataagtactttttaataaactaaacatctgaactgcatgataccatttacggtgaagtcggtcttcagcacaatcataagagaaagacaattcatcattatagagaacggataccttttggctagtttatacttctgtcacacttccttttttaagtgatctactgaaaggaagcgaaccatgtacgcaccagaagaaattgttgaaatagcaatcaaaaacggggcaaacaaaacaaaaaaaacactaatagcaaaatgtttgttaggctttattggcggtgctatgatttctttgggatatttagcttatatccgagtatccgcccccataccatcaaacttttccggattagggacattgttaggatcagcaatttttcctattggattaatcgtcattttactagctggcggggaattaatcactggaaacatgatggctgtaacaattgccttttacgatcaccggatttcttatcagaagcttgtaggcaactgggtattgattacaatcacaaacatgattggagcaatttttgttgcctatttttttggttactttgttggactgacgcatactgatgtctttagagaacaggtcataaaaatagcgcagcacaagctaaacacttctttttcacaagccttcatttccggtattggctgtaactggtttgttggactcgcattatggttatgctacggtgcaaaagatgcggcaggaaagattctatctatctggtttccagtcatgattttcgtggcaattggattccagcatagtgtcgctaactgctttgttattcccgcagcaatctttgaaggagaagctacttggaaagcgtttgttttaaattttatccctgtctatctaggaaatatagtaggtggtgcagttctcgtatctggattttattatcttagttattcagcaaaaaatgctactaccaaagataactagcacagaataaaagaagatgaacatatgtatcctcaatacgtatgtttatcttctttttaagacgtattcctattcgttattttccactataaaatagttcagcacctacttcgcaaatgcatcttgccctccatacttattctggtggatgatctcactgatcaagtactcgtagatggaacgcggaatctgtacaccatcttgctttgctttctcaaactgtagttgactgatctcgcctggataatagaccgttgattgtccttctacaggcggaatttcatgtaattcatttaccatttgatccatctgttctttaaatgccgaaagatccgtaaagcgtttgggatcaatgactagaaacatttgtcctaggcgtcttttttcagtgagatcggcatacatagaagatacatgtttcccgaaaggcagtcctaacagtgaaccggctaaaatatccaccatcatcatcaagccatagcccttggcgccagcgatcggtaataatcctttaacgtccgtaggatctgtggttggttgtcctgtctcgtccactgcccaattttctgggatcggctgatttttggctcgggcatcgagtattttgccccacgcttgaacggtggtagccatatcaaaaacaatgggttcatgtcccgctcgtggcgcagcaaatgcaattgggttcgtgccaaagtaattgcgggtaccgccaaagggaactgccattggatctgattgacacatcgctaatgcgatcaactcttcttctgccgcttttttgacataataagccatggtaccactatgactggtttgttcgacaccgacataggcaattccagcttctttggcaagatggatcgcaatcttcatcgcttcattacagacgtattgtcccatgccattgtcgccatgaaaaatccctgtagcagggccggttttctcaaaagataatttaggcgccaatgtgattccgcctttagcgatccgttcggcataatagtccatgcgtacagcaccgtgggaatggacacctgttgcatctgcaatagctaaatgtttcgccgtttcgctggcagcttcttgcggcaacccagcagcaatcagttttttcttcatcaattcttccaattgagtaatagaaagagtgactagttcttccatcgtgaatcctcctttaacaataaaggagaagtacctgatagtgacaacagcgacttctcctttctcttattgattaaatatctgatagtccaattcatccgcagatttcgcaatgatcatcgcagaataaacatctgaattgacattcaaaatcgttcgcagcataccgacaaaccattctacaccagcaaaaatcgcgatactctcgattgggagtcctaattgagggacgacaatcgccagtgaaacgaggccagctcccggaacaactgcattcgccaaggacacgaatgttgcagtgacagccactgtaatcatttgtatcaaatcaaaaggcatttgatacatctgggcaatcgtcatcactgtgatcgccatatgcatcgcagaaccattactatttaaagacattcctagtggtaagactagatttgtgatacggctgcttaatcccagcttatgttgggcttcttccatagcgaccggtaatgtgatggcggacgaggtagtcgctaatgccataatggtcatatttttcatattttggatcaagcgccatggattcacgcggcaatagatcatcaaagcaacaatccataaggcaagaaacgtcagtgtggctaacccatagattagaagatactttcctagaggtaaaatgatctgtaaccccaaagaactgatcgttgaagcaatcagcgcaaagatcccgatgggcgctaaaatcatgacatagcggatgatcgtcagcacgacttcattcaagtcaacaatgattgttaataattgcgactgcggattcttttgcaaaaaacgatttaaagcaatcccaaaaaacagggcaaaaacgatgatctgaataatcgatccttttgacaaggcatcgaaaatattggtaggaataaaattgatcagcgtctccgatggtgagatttcttgcgcttggacagtgtcagcagccgtttgtgaaaaatcgatccctttaccaggggtaaagaaaactgccattgcgacaccccaagccgcagcaagtaaggaggaaatcccgaagaccgcgattgttttcccacctaaccgtgtcaattctttgggggcaatgcccccaacagcctgaatgatttgccctaagatcaataccggtattgccatttgcatgagccgtagaaaaatatcgccaacgatttttaagtgaacgcccgcttgtgaaaacagcaatccaaaaacgatccccaacaaaacagcaataacgatttgtgtgaccattggtattttttttattttcaccttgatcccctctttatttgcggagtatagtccctacctgttgatcaagtacagctaaattttcaattgaagtaatgatcgctgtccttgacgcatcctcgtttacaaagccgatggctgcctggatcttcggtaacatactgccagcagcaaagtgtccttcttcaatatactgttctgcttgctcgacagtgatttctttgagagcttgttggtctggttgattgtagttaatgtagatattatcaacacccgttaaaataatcagacgatctgcttggacattgtctgccaaaaccttggctgcaaaatctttgtcattgactgcttccacgccaacatagtgctgattttcttgataaacaggtaccccaccacctccagcacaaatcgtgattaccccggcatcgactagggtcttgatcacgtctttttcgacgatttcttgtggcatcggagaaggaaccacttttcggtagccccgtccggcatcttcttgatagacacccccggttttagccatcgctgcttccgcttcttctttatcataaaaaggaccaatcggtttcgatggtttctggaaagaaggatcgtttttatccactctgacttgtgtgattaaagaaatcacggattgcggcacatcccgttgggcaaattcattggttagtgcatgttgcaaccaatagccgatacttccttgtgtcatcgcaacacaggtatccaatttcagctgtggatttttttcgctttcagcagctttttgctgaagcagcaaattaccgacttgtgggccatttccatgacacaaaatcacttgttcgcctttttcaacaaaatcagcaatatatttggctgcttgagcaactaccgctttttgtccactatcactagggtctttatccaaaatggcatttccgcctagtgcgatcacatttaaactcattttactgtctccttctcattttccttcgctaatacggcaaatattcctaatccgatcagcagcaacacacacgataagtaaaaaccgacttgcattgatcctaatgaatctgctaaaaatcctgtgacatatggcgcgaggatcgaaccagacattccgatgaagttgtaggcactaagcgtcgtgcctaacgctccggctggtgcatttttcgttacaaatgtcaccacgattggatcaagagcaagcttgcccgtcaatccatacaaaatcaacacggcgatcaatatcgtgcggtctgtaacaaaggcaatcgcaaaaactgaaagtgtcgcaaggggtaccaagaaatacaccagttttttcgttgctcctgttttgtcgttcaaccgagcaaaaatcaaggcaccaggaatcgaagcccatgggacgagagaagcaataaatccaacacttgctccttcaaatccacgttctgcgatcaaaaattgtggtaaccatgtaatgataacaaaatttgcataaatgctagtaaaacataagataaaggcagccactaaattacgattagaaaaaatttgtttaagagagattttttcttttggtccttcttctttaaccactttttcttcatcttcaggacggatgactttctctttcaataccgtgtaaaacaagataccgagaatcaatgttgggatcgccatgataaagaatggtttgctccaatgatcgccattatccaaaacaagtttacttgacaatagatacccgccagaagtcccaaaagccattccgctgttgataatcgcattcccaacggttcgtttgttatctggaatcgcttctgttgataacgcgtattgaggcccataatacgcaccttgaccgataccggcaactgcgcgaatgactaagaacaagacaaaactcgtagctaatccactgaaatacgtggtcacggccagcagtacaaaaccaatggcaatgactagctttcgaccgattttgtccccaacgatcccaaaaggaatttgggctttagctcctttatcaaagaaaatcagctggaacgactgcagcaaagcattcccccaaagttgtaccaaatgtcagaagaagacgaggaattattcactactttctatactttttttatcagcaaccgcaattacaagaaaactgccgaggctctttttctgcattcgaaaacgattcgctatcgtctcaacaaaatcgagcagttgctggagattgatttgacaaatcctatccaattggtcaattatgaaatcggtacgtatttattagaattgaagaaaaggagtcgtttataaatgaaaacagactttttattatctaccggtgcctcagttagtctttatcctgctgattccattgagcaagagagctatctgatttacttgcatggcggtggattcgtttacggcagtcggcaggatattcccaaaccattgatcgaattgtttcatgaacacaactatacgatcctatctatggactatttgttggcaccaaacagttcactttctgaaattattgccgctacctgggagaatttcttggaattaaaagcgaaagtaatcaaggagcacccttatcgaatctgcggtcgttcagcgggagggtatttgatgatggcattgacgaaaaaaatttttgctgaaaaactgccaatgcccgaaagcctaattaacttttatggctatacagacttagctttcattgaaacttctcgtcagacgactcaaccaccattgtctgagtcccttctgccgaaaatcgagttaacagagaaagtatgggatgatccccagtttcagcgttatctcttttatatttatgcacttcagcaacaaaaattgactgaggtatatggcatttcctccaatcagttgacggattatgcgctcccagcggaagagctacaactctttcctcctgtttttagtacagccagcagtaccgatgaagaagtcccatttcgctatagtaaggcattaaagaaaattccagatagtaaatttatagctgtttatgacctgccgcatgacttcctgaaagaaacagatgatgaccaagtccaaatggttttttcccgtttaaatacctggttaaatgaccactgacaaaaaaactaaaacaaaatcatttttgacaggcagcagagtgttataaaaagaaccctctgctgcctttgatcaatttttcttctctttcaacttgaaaatcagcaaataatgcttacttacaccaagattgctggttacatgctatactaaaaatgattatttgaaagaaagaaggatgaatttaatggaatttgtgggtatcttatgcctaatcctcctcacaacaactcttttctctcatatagcaagacggattggcgtccctgctgtaattgggcaattgttggctggtgttttattaggaggtgcaggacttaattgggtacatccagacattttagtacacgatttttctgagatcggtgttattttgctaatgtttttagctggtttagaaagtgatatatctttactgaaacgctattttcgccctggaatgtttgtagcgatcttggggatcctcttcccgatgttattcggctatctcacaggtatcggatttcaaagcagcggaacggaagccttcttttttggtattgttctagcagcaacttctgtcagtatctctgtcgaggtactcaaagaactaaatgttgttaataccaaagagggttcgacgattctaggcgcctcagttgtcgacgatattttggtcgttttggtattgagcctcagcctttcctttttgggaggttctggtacgcaaagcacccctttgcctgtcacactatttgtagaacttatttattttgttttgatcttcttacttgttaaatggattgcgccgttcttactttctttagcagaaaagctctttgccaatgcctcagtcatcatcatgtctctgatcatctgtttaggtatggcttatcttgctgacttagtcggtttgagctctgtgattggtgctttctttgccgggatcgctgttagccaaacaaaagtcaaagaagaagtggaacacagtgtagaagcattgggatatgccgtgtttattccagtattctttgttagtgtcggcttagaagtagacttttctttgttgaatgagcaattactctttatcttagcctttacggtagtagctattttgactaaacttgtcggaggttttgctggcggaaaaatcgctcagttctccaacaatagtgcttggatggttggtgcagggatgatatctcgcggcgaaatggctctgatcattttacaaatcggacaacaaaataacttgatcacacctgctctttattcacccttagtaattgtggttttattgagcacactgatctccccactgattttgaaatattttacaaaaaaaatctattgatgcatcgtaaaaggcaaaacaccttctcaattcagttgagaaggtgttttattgtatttaaagcaaaaaaacattacaataaagctatataggatcaaaaggccgacaacacaccgtgaaagggcgtattctcatgaaaatcatcaagaactccattgaaaatcaccaaaagaaaaaagagcaaaaaaaactgattttaagaaaaaagaactttgaattacgtgaaagaggaaaagatcctcataaagggtggcaccccatggtcgataccggatccggcggtgcaaatggtgcactcgttaaaatcaatagaggcaccatcgatattaccggaaacaatgacgaaacattcaactattttttagaagaacaaagacgagttgctgatcattcaaaaaggcagaactaactcttgtttagaatgactggcaagagcacttttcaactgcttctacgataaatactattcaatccagacggtctcaatcagtaaatataatagtcatcgcttcctgctggatagatctcgatcactaatttatgaggcaaacagatactggtttgtccattttgagagatccagcccgttttaacagcaatctgatctggactattgtcttctttcacgcgaattttcccgttatttatttcgataatattatattgttttctagacggagcatacgtttttgtcaatgattcaatttgttcgagattgaatcggtcaacctcctgcccgttgattcgaacaatggcgtaacgatcacctgtatgttccgtagcttgggcagagaaaaagactggcagaaaagatcctacaatcaatgcagcaaagaggaggtaatcaaagggttttaataaacgaataaaagaatctagcagcctcattcgtatcacctctttctttttttactgttttttctttaaaacagctagtcgtctagttatgtcctttgctgatttcaataattgaataaaaaggcattggcaaaaatcacctgattttgccaatgcctttttattgaatacaattaaaatcataaatgattggttgtgctcatcatgcgtttcaatggatgcttcctgtttttgcatcattgtcagctgtggctacttaaatcgtttcttttttaatggtttcaatcatttgatcgattgcttgtttgatttcatcttctgtatcgggtaatttgcttggtaccccatcatgcttaccactgtcgacttctccggaaaaacttacttcatcccctgaaacattgatttggtcttgatacccttttacagcgatataggctttggcaagcacctcagtttctttcacatcttcaatttttttcattgtacttcccctcctgaatcttattgtagcaacttctatttaaaaaccaaattgatttgctttgtttttcccagttttaatatctccaaaagaaaaacgaaagtaggaagggctatttttcggatggaaaacaacaccgtttttttgttaaagtatttgcatatcttctattgaaaaaagcttttttcaattgatctttctattcgatagttggttctgataatctacggtcttcaaaataagccgataaatcaatcaattcatcctctgtaaactgattcatttctacttcacctaaaatcctttcttgcagtgttcgatccatttcccagaaatggtcgatctttttgaaatggtcagccgaaaacctggcaaatactggataaagaatcaagaagtcagtgtatgtcaggtccatggactctgtataatcctttacgtaacctgaatctaatgcttctttggttggttcaccctttggcccaatcaatcctttgtgatataacagctgaaaaatttctgctttagtgactgtcggatcaactttctttttgtagcaataagcctcttcaaccaatgatggatattggatcatcattattctctacttcctttcagtcatttgctttcgttatgatcggtttcttcaaaagatattcctttaatgacacatggtgacttcgtgtataattcccactggtactgtcaaaatggatggctggcttcttcaattgttgatttctccgccgccggtttttctttgcctttgaagtttttctagctggtactgccattttttaatcctttcttggaaaaatagtttcgttagctaatttttttcttgttccgcttgtattcatggataatttttagcgcacgcttgcgagtcttgatatttggatttttcaagcggcgataagcacttgccagatctgttttttccaatcatttttcctcctttatcgtcctacttctctctttaagattcatctgtattctttactcacttctttatttcacgaaaaattgcttttcgccgtagttttggtgaatatttttttaattccaatcgatagggtgtgttgcgctgatttttgctagtcagatagagtcgttctccggtttctacacattccaatataatattattttgcatcctcaaactccttccaaaaatctcttcaaaaacaaaacgtaacgattacgttttaaaccttatcatagaagagtagaagattcaagaagttttttatatttttgttattttataaatgaaagatgtttcatatgagtcgttgatcgtttctgaaaaaaattctatttaataaaataccagaaataaaaatagctgtttctctctttaaaaactttgatttaacaaaaaaataagatacccgcaagctggtattttagaacaacttcttaaaaattgttctagtaattatccaatactttactggtatcttgttttttattattcgtgtgtcttcatccattccgtgatagccgataagcgttcaagacgtagattgggcaacccgctgcgagaaaggccatgactagaatgcggaaagaggatcaatttcgtgtcaatgtcattccgttttaatgccgtataaaattgttgcccttgttcttgcggacaacgcagatcattttcgccatgtaaaacaagcgttggtgtgctgacatgatctgcatacgctaatggtgacatttcccagagtgtcttagactcatctaggtcatgcagcaactgatattttacgaaaaatggtccaatgtcgctggttccatagaaactgatccaattggagatcgaccgctgtgtgacggcagagcagaaacgatccgtgtgccctacgatccaattggtcataaagcccccataactaccgccaacgacatgaattttttggggatcgatctctggatgatgattaagcacgtcatccacacctaagagcaagtcttggtaatctttattgccataatctcctaggatcgagcgaacaaactcctgaccatagccttgcccaccgcgaggattcagcaatatcactccgtaaccattggctgcatgaacttgcatttcgtgaaagaaagtctccccgtagcaaacttgcggtccaccgtgaatatataaaatcgcagggtgctcttgactggtctcgatcggtggtagataccatccttggatttgccaaccatctgctccctcataccaaaaacgctgcggttcactgatcgacagttcattcatcagagcttcattcggatcagctactagttctagctcgccactagttaagtcaagcaccgctagtcgacttgggatcgttagtgtcgaataagtgattgctaagtgggtttcatcaatctttgctgcatcagtgatatccattaattggtcaaatagtaatgtccattgtcctttcgtatcgacacggtacaattgcaattttccatgagtagtcactggtacaataaactgttgtttgttgatccaggttactgaaacaccacgatttttttgttgaaaatcaccgatgatcgtattgccgatggcaaggtcttgttcatttgagaggttgactacttcctttgtttcaaggtccatgagataaagatcttcctgggtaacaaatccataggttaggtcattccccaaaagcagcaattggttgccagataaagcagcaaaagaataagtcccttcaggcagatcagattcaaatgagtgatgctgattcgttgtcagatcatacgcatacagcatacttccataatgccattctcgttcgggtttcgtctctgcggtatagagtagaccttgctctttttccatgattgcttcaagatggatttccagatctgtttcaaaaatagttgctgattctttcgtcgttaataagactttctttacgcgcgtgattttctcagataaaaagcccgcaccatctgcttgatagcctaatttggtcgtcatttttattttaggaaaatcgttttcagcagctttttcttttgacgtatcgtattttttctcagagtcatccactcgttcttttgatttatctgctgagacttgataatagaccgctgtagcatcgtctgtccaaaaataattgctgattccctgctctgctactaagacagaagctcgtccaccgtttaacggcataatcattagttgatttttttctgtttctttctctgtcgacagaaagctcagccatttttcatcgggagaaacttttagctcggtactattttttaattggttgccccatacctgcctttcttttgtctctcgatcaacactgaaaatttctgattgatagcagttcttttcttcgttaaccgtattctcaagataaaagatacggttcccagccgctactggctgtgccacactcttcaactcaaacaacgactctttttttattttcatttacccgcctccaaaattaggataattccattatagcaaaatccgctgacgtgatgtcagcggatttactctttattcttaataggtatatccacgaacgatgccggattcttcaaaaccggcagagaaacccgtttgtcggaaaatcgtctgaccattttctatcaacgtcagcaaaatctccgtactggcactttcccgaataattcgattcatcacaccatccgttggtgccatcaaggaatggccctctttttctgcaacttcaatcgttagttcaagcactttttgcctaacaataatcactaatcgaccttgtttgcgagtcacagaatctaagcgggcaccataatacgttgccaagcgatattctttatcccctatttgtaagactgaaataatccctaaaaaagccgttcctaaaaaaggaatgtctgctgctgagaaaaagaaacggacatcaggtgcctcaaatcgattgcattgtacccatagataggcagcaggaaacgaggttccccagtctttttcgagatacccgattccttcagagaaatcaagtgactgctcattccatagcaaagttcccgagaggctatgagccatacttaaaataccatggtagcattccataaatgaaaggtaggaaaaaggccccataatacttggtgcatagcgactccgagatattggatgaaaggcaccgtaggtcaatgtgcctttaactgataattcagtactctctaatgatagcgaaattccttgttcactaaagtaattctccccgatcttaattaataactggtcttcagcagctgaaaattccgcttcactaaaggggaaataatgggatccttcatggctgatcacttgaataaatggctgttttcttccatccgattcaatcgatagccctggaataaatgcatacacctcatccccaatttgatgtttgaaataccatccttcaaaaaatgcagctttcttcgtattgccatgaaaaaaaagatctgttgtaatcgccatacgttccctccattcagctacaactagtgtagcatgaatggcacaaaagatgggttatgacgttttcaccaatccaggattgtaagatctacgatttttctgttcgtattctcgatcacggcttacttatcttttgcagaacgtctggtccaaaggatataaacagcaaaagctgccacaagcaatgcaatcaacagccctttaaaccgattatcatttgtcaaattctctttggaggcccatcgttgaaggattccaagtataacgaaaatcgttagcataaaggcgacgggataaaagtctttttccttgcgcaagaaaatcaaggcgcaggcagcgactaatagcaccaacattagcaccatatccattggataagataacgtcaccacaaaaaggttaggggtatatagattcagtaaaaccaaaccaccaatccagactatcgctatcacccacaaaaccaaaaatttctttaacttactctgaaaaaaaccttgctttaaataaatcgttttttgcaccccaaagaaaaagaggatgaccaaaacgactgaaaaaacagcagttgtcacataagaataaagatttaactgcaagacactatcagaagaaaagtcattaaacagtttgaccagccatgagacgccgaccataatataaatcaaattcaactgatcgatcaaacggcttttaggtgtgttacgcaacagctcatctgccatttctttaggatttttcccaaaatattcttctgctgtttcaccatgattttgggcttcaagtaaatcattggctatctcatagacttgagcaaccacagcatattcatcttgaaacaggctagaaaaaaataagtactccctcaaatcttcaaaatatttctgattgcttgctgacagttgttttgaaatctcatttgttttgtctcggtaataagctagttgttttttcttattcatgttctcactcctcaataattcgttctactttactcactaggttttcccactgttgtttaaagctgtttaggtactcttctccagcttctgtcaatgaaaaatatttcctgtctggtccatctggtgattttttcagttcagctttgatcaaacgttgtttctccagtttctgaagtaaggggtaaatcgtaccgccaacgatcgtttcaaaaccatatcctctcaattcttgtacaagctcgtacccataaatttctttttttgaaataatctgcaagacacatccatctaagacgccctttaacagttgcgtttctctcacgacattcacctccacgaatcatctcctactagtatgttttacctattagttgatttgagtatatcaaaaagcatctagtatgtaaagcatactagctaaaaaaataaaaacacagtacgtgtaaacatactgtgttttcggttatcttttgattcctcgcccataggaatcattataaggttgaaatgagcgatcgtggagctgggtagcggcatctgccaaccagtgaatatttctaatcaacgctcgtccttgtaaaattaaatccgcttgcttggtttgcagaatgtgttcacataaattagggttatccagcatcccaacggtagccactgggatcttaacagctgctttcatagctgttgcaaaaggtgtttgatacccttcataaaccgggatcgttggctttctatctaacaaaccgcccgtagagatatctaaacaatcaatcccatctgcttcaagccactgtccaatttgttgccattctgtgattgaattttgtttatcctctgtttcataatcggttaacgacaaccgcatccaaagtgacccatcaaagacagctcgaaccgcttgaacaatttctttgacgaaacgatagcggcttgctaatgatccgccatattcatctgtccgctgattcacgattggtgagagaaattgatcaatcaaatatccgtgagctccgtgcaattcaatcatgtctacgccagcagcttgcgcacgtttggctgctgccacaaaggattcttggacacgattgatttcagcaagcgtcatttcgtgaggaacagcatagctttcgttaaagcgaacggcgctaggtgctattgggtaacctgcatccgctgctttgcgcccagcatggttcaactgaagccccactttgctaccgaaaccatgaagcaatgcaacgagttttgataactcaacttgttgcgcttcattccataaaccaagatcattcttggtgattcgtccatctgcttccacagcagttgactcaatgatcagcaagccaactttacttaatgcacgagcaccatagtgaacaaagtgaaatggcgtggcaatcccatcctcttttttcacttcatacatgcacattggtgaaaggacaacacgattctctaacgataaccccgccagttcaactggcgataatagtaatgacatactgacattcctccgctactcattaaattgcattttctgcttgttatcagtatagttgttacacatagaaatacaagcagaaagagtttgtttttttgaacatgaatcaaagaacagtaggcgaatagaccaaaagtcaatttactttgctgaaaactacagtctcccgttagctaagtatggagttagcctttattatttttaaaaacaaaaaagaattgctgattaataattctatcagcaattcttttccctatagttattataaaggaaaaaacgagtaaaaaacagactagtatttttgccgccacctcgtataatgaaacatactctgggaaatggatgtgaaaacagatggaaaagcaacgcatattagagaaacgtcatttatcttttgtttatcaaaaattggtcactcgaaaaaaagccctacgctcttttctggataaaggctacgcaagccatttgcaagacctccaaacaattggcacggatattcgactcaattttgataacttgtcagacagtctggaaacttatgctgccattgagagcaaaaatcgtgaaattgaccaaatgaatctgagtttgcaaacagccgaaaaagaactggcagccgtagaacgtttgctccagtcaccctattccgggaaaatagtcgttgactttcttgatggtgaatccgctgaatccttttatattggcatcaacggctttgcagttgaagatagtcataacttagtctatgattggcgctctccaatcgctgagcttttttataacaatacgttagggaattcttcttaccaagtcaatgaacatgaaattgctgtatctattaaaatagacggcaattaattgtcgctcatgataaactgatccgctttttcgatacttctgtcgcgatccaagatgatgtcttattgaccgcactagaaaagaacgacggcaaaaaaatgcgcgacatcacaacatccatccaaagagagcagaatgcagtcattcgtgaccaatcaagtcaaaccttattggtcaatggagtagccggtagtggaaaaacctaagttattatgcaacgggtcgcttatttattgtatcaataccgtagtcagatcacatctgacaatgtactgatcctttcacccaatcaagattttatccactatatctcagatgtcttgccttcattaggtgaaaagaatcctttaaatcagatgattcgtcaattttgctcgtatttgctgcaagaagcaaatacagttcctttagaaaatgaggaagcctattttttccgtttacaagaacctacttcttttcaaacagaaacgctccgcagcaatgagtttgtggcctttctgcaagaatcagccagcaagacagccctgatcgaaccttcgtttcactcaatccttcgaaagggtaaagtcgttatagccaaagaaaagattcagtcaatctatcaatctacaccacatctccctatgatcgagcgattgcaagcaaccaagaaacgattaataagtgagtgggagtcacaattgatcagaaatgccaaaaagaaccacttgcaagatcaagtattagcactttctgaacagcagcagcaacgatactttggtcatttgatcgaagacgactctccctccagtattcaaaagtatactgaacaattattgcgaacgaggtatcaagtcgttgatgaacaattgaaacagaatagctggatcgatgaggatcaatttttagaacactattatacggcgttcacccaacagccttatctgaaacattctactatcacgttagatgaagcagtaattcgtttattcaaccgacacctatttatcgagaaacttcctgtagcctcgctggcttttttgctgatcgatgaaatccaagattatacacccgctcagtgtacgctgttattgacactatttccccgagcagccttcaccatggttggggatgaaaatcaagcaatttttaattctgcgattgattttagagagattcaagaaatctttgaggctaacaatcgatcagtcacacgctatgacttacgaactagttaccgttccagtggtgaaattactaaattgtttgcaaagcttgccaaccatacaactatgtcgatcatgcctgttcgcccggccggagagcctccccgatttattcgttttgaaaacgagttggaatggctggcaactatcacacctttcataaaaaagggaaggcaatatacgatactgacaaagagccataaggaggctgcttttttggaagaatatctcaaaggacagacaaatcaactcccctttcctgtttattcgattgacatcgctaaaggaagagaatttgatcatgtcattctttatgacgtttcaaacgaacaattctatacaacacaagacaagcgaatattgtatacactgctgtcccgtggcatggaaagtatgctggttacttataaaaaagaacttagtgcctttttctaatccgaaaaccattgattcttgaataaagcccagaatcaaactactgccagatccagcacttaacaactaagtttttttagaaaaaagtacctttttgtctatttgagcaaatgcatctgcccaggcttaggataaatgaagtttcactttatttaccctaagcctttttgacttgtcccttcaacctccgactcttcttcgttgatccgcatccctttgtgataatcttacttgtcttcttctatgatcttaaaaacgtagatgcaaagatttcccatgggatgagaactagacggaataatttcgtcacaacatttgtccaataattgaaattgcagcggtcgtcaaccctggaagctcgtgtcagttgctccaattcaattgttttattcaagcgcggaaggcttttttacataaattttcacaacagtagagcattgaagcccaactgtcagttggaatagttggagcagcgtccgctatttgcagatacaaaaaaaccactaatgacgaatcattagtggttaaatctattgattaacgatgaatgtaagtataaccagatgcattcattgttgctgtgtttggtcctgtaggtgaagggaagcccattccaccttgagagatcgtaatggtgttgcttgaaggatcataagattctacataggctacgtgtccatacgtaccatctgctgtccactctccgccaacggattggcctgcggcaaagacaacaactgctccagcggctggtgttccattcactgtgtatccatcagctgctgctgaggcaccccattgggcaccatttccccagtaagtaccaacccatggtgcgcgatttttaacataccatgtacattgtcctactgcatacatgttacctgatgatgagtggtctttaccactaccaccggtattgactgtagaattattgctgttatttgtatttgatgaagaactgtttgatgaatttgaactattacttgatgaacttgagctgcttgatgatccagcagttgctgtttcaacaacagaagtatctgaagaactttctgtcttcgttgtacttgtttgaacatcttctgtaacagctgctttttcttgtgcttctttcaatgctgctgcctgttttgcttcttctgcttttttagcagccgctgcttcttgttgagctttcaagacacgtgctttttcagcttccgcttcttgttttttcttgttcaacgcatctttgtctttttcagctgttgcttgttcagcagctaaattagctttcaacacattcaagtctgcttgttttgtagccaatgcatctttttgattttgcagctcagcttgagttgctgctacttcttgaattttgctttcattttcttttactttttgttcaacatcttctttgtcgcgtttttgctgctcaactagatcattgttggcatttacgattgttgtcatggcttgtactcgaccaataacatccgtcaaagaatctgcttctagaactgcatcgataaagtttgtgctttgaccatttacttgcacatcgcgtgcttgttttttgatggcttcttcacgttttgcgatacgtaattttaaagtggcaattttatcttgtaatttttctgcttctttacctagtgcaacttgtttagcttctaagtcactgacttttgcactcactgaatcaatttctgcttctagagaatcgatttgtgattgagcatctgcttgttgtccttttagggaatcgattttttgattttgttgttcgatttgatcatcaatggaatctgctgatactaatcctggtcctgcaactgctgttaatgttagagaacacaccattaatgctgataacaaacttttcttcactcgtttttcctccgactagcgctttttgtgtaaattagttgtcttaataaaaaatttacttaatataagaaaatttaaagttcgatttaacgacaaatgaattctaacataagcatatgacatacagataaaagaaatgttacaaaaatgtttcaaagacaattctcatcagaaatattcttctatgctagctataaagcttgataaaacagcatttttaaaatgtttttcaaaaaaagaaatcgataaaaaagcgcttttttatttttcaggtagtccaaaaactcctgaaaaaaccaaaaaatttgcttttttacagtgtgaatccccttttttctctcttttggccctctctttatccgtttcttttttcattaaagaagataccgtgtaagcaaaatacttgatcctttctaagtgacaagcaagttttctcttcctataataggaagaataccgctcgaaaggaggaagcatcatttccaaaagaaaaataattatctggatcagtagcattttggtttgcggcttacttttgcttgctctttggacgaccaaaaaagcgaacagtgtgttgcagcaagattcagaaagcgaattttggctgctaagcgatgttcatttcctgtcgtcagcacttcacgataatagtatagccttcaaccagtttgctgaaggtgccgctggtaaagaaatgcgctatcaggcagaaagtttggaagcttttgttgctgaagccctagaaaaacgaccaacaggagtgatcttgacaggggacatgacattgaatggagagaaagcaagtgcagaatctcttgccgagttattggcaccattacaagaagcttcgatcatggtactgagtttgcccggcaatcatgagatttacaatggttgggccagaatttttgatggggataaggaattttatgccgatcaaatcagcccgcaagatttcaaagatattttttccgaaggctacgagaaagctgacagtgttgatcggacctcattaagctatagcatcaatctcaatgatcagtatcgcttagtattacttgattcatgtatttatgaagaacaagtgaattggaaccagccaactacgaatggccgcttgaaagaaagcaccttagaatggctgaaggatcaactagaagcagctaaacaacagcagcagacaccgcttctcttcatgcaccataatcttctggaacataattcattgttgaaagaaggttatattttagataactcggcgcaattgcagcaattactaactgcttatcaggtaccagcgattttttctggacacatccatatccaagatattacagaaggaccctctggtattcaggaaattgtcaccggctcttattccacacaagaacttggctatggggtcgtaacacttactgataaaacgatcaactacgaaaaaaaggtgattgatttggaccaatgggctgctaagaacaagcggaaagatcctcaccttttgcagtatagcaactatcaagcaaccatctttcaacaagatacaactaaaatggtgcgccaacagctcgcatctgttactgaattgacagaagaacaaatcaacacattatatacatttattgcaaagatgaatgcagcgttatttactggtgacgacgtttattcgcaagaagaaaaagaaacgattcgacattctgaagaataccagctgctggcaacatattcttattttctaaaacaatatgttgactcgctattggaagataagagtccagataatgcgctgacacttcccataaaatgaacgatagccttcctgtcataagacgggaaggctatctaacgatgcaatatttattctttgaaagttgaagcagactattactactattatttatttctcatttaaacgatgcaatccctaacctctactgcatccttgtaactctgaagttacgccagttttgaataaatttcctaaaaacaagataacgttggtacaaaaatatttctcgtattcaatcagtataacacattttggcaaaaatgtcgtcaacagacttcctctctccattcttgtgtagatttagcttggtattctttccttaacaggcaacatcacttcaaaaatctgctgttctttttgatccgtggatacatcatcttgccacatcagttcccagatatctccatctatctgtaaattagctgattccagataggctttgaatcgttttgtaaaatcttttaaatgatggatctcccctctgacgaatcccgacacataatttcctgctggtctacaaataattgcttgatccgagtaaagaggcagtcgttctttgggaatcatcactaatgcacggtaaggcgcttcatggatcgactcttgatcgaatgcagatccttctactaaataaccgatggggtagccactaaataaatccttgtaatctaaataaggataaaaacgtgaaaaagcctgaaagaccgaagtctcatcatactcattgatttcttcagaaacagcaaaatatacttctgaccgataactataagtcatattggtaaaatcggctgtctgtactttttcaaatcgcgaaatgaaccgatccaaaacggctttatgttcctctagttccgttattttctgatctacttctttacgacggatgatcaactctttttgcatcgtctcaggattgcggtttcttagaaatgtttggatttcctctaaggacatatccaatgctcgcaagaccaaaatcacatctaattccgcacactgttcaaatccgtaataacgatacccgttttcaccgatctgtttaggtttgaacagcccgatttgatcataataaagcagtgtacgacgactaacaccgccataagccgcaagttcactgatggtcaaaaattttttcaaaaaaaatgcctccctcctattgactgttacgttacgttacagtttattctagcacagaacgacgtaattggagggaatttttatgaaacaattaaaacaattttttttcaccgaaaaacgcctatttctaggtacttttttatttatgctgatccattctttcgggacactttttcttccctattttgtagccaagatcattgatgatggcattttaaaacaagatcaatcagctatcatccgctatgggggctggatgctggctgttgcactaggaactggtgtgattgctgtcagtgctagttatttttctgcccatctagcagggaaattcggacatcatcttcggatcaaactattcaacaaaatacaggagcttgcgatctctagttttgaaaaatatggtacaccaaccttgcttgcaagaacaacgaatgacatcaataacattcaacaaatcttgatgatggctttacaaatgattcttcccgctccactgatcattttggcttcgattattttaacaggtagtgtatcttggcgaatggtgtggatccctattgcagcgattgcttgtttctcgatcgtcgcacttttcgtcatttatcaagcaatccctttggcaaagaaaacgcagaaaaaagtagatactatgatgcggattttgcgtgaaacctatacaggcgtacgggtgattcgcgcctttgacaaagctagtttcgaaaaaaagcggacagaccaaacctttgaagggtacgcaaaagtgatgatccaagtcaatcgtttattcgctgttttgaatccagccgtacactttttcatggggctgtccattctaagcattttgggattcggcggtttccaaagtctctcaggaaacctgcccatcggcagtatcactgcgatcatcgaatataccgttttgagcctttggtttttgaccatggcagcaatggtgatcgtcatgatcccaaaaggattgacatccttgcagcggattgaagaagttttgtctgaagaagaaacgatggcagacggtccacagccaatcttgccaaaagaaagctcattagtagctgcctttcatcatgtctccttcacctatgctggggcagtggaacccgtactggaagatattgattttgagatccatcgcggacagaccactgcgattgttggcggcaccggatcaggaaaaagtacgatcgccaaagcacttttgcggttaaaagacgtttctaacggctcaatcacattatatgatcgtgatattcgagaagtctcacaggtcgcactacgatcatttatcagctatgttcctcaaaaagcattgttgatcagtggatcgatctgggacacattgactttcgggattgtcaatcccgatccgcaacaagtagcacaggccgtcaaaatcgcgcaagcagagtcgtttatcaaaagtctacccgatgggatcgacagtcacgttgctcaaaagggcagcaatttttctggcggccaaaaacaacgcttgagtatagcgcgcgcattagtgaagcccgctcacatttacttttttgatgacagtttttcggcgcttgactatcaaacagatgcaaatttacggcgagcattaaaatcttatgtccgtgattcagccgtagtgatcgtggctcagcgtgttgcaactgtcatggatgctgatcaaatcatcgttcttgatgaaggaaaaatcgtcggaaaagggacccactcagaactgatggaaacctgtagcacctatcaagaatttgcggcttcgcaaggaataggaggagaaaaaaatgagcaaaaaaataactgatgcaccaaaaaatttaaaacatacgagcatgcggctcttacaattattattccagcaaaaaagccgcttcggactgattttgatttctgctctctgctacgcgacacttatgacaatcgcaccattactgttgggtcaaggattggataatctcatcactttgcttcagcaaggaggctggcaaccaagtgaattcttgcaagtcatcaaatggccactgctccttctagggatctcctggctgatgattagtctattttcatttttacaagaatacacaatggcaagtgtcagcgaaacattgaccttaacccacagaaaagaattgacgcacaagtttaatcggttgccggtacgattttacgatacgcatcagacaggcgatattttaagccgagcaattctagacctggataaagtctctgaagtccttcaagtcggattgatgcaactcattacagccactctcagtatcttatttggtcttggtgtgatgttttggctcagtccattattaactgtagggattatcattatcctactgataagtgctttcgctacccatcgactggctcagcgaaatttggtttacttttcagaaaatcagacaacattgggagcagtcggtagccgggcagaagagttttatactgcccatttattgatcaaatcctacaatcagcaatctgctgtcgcttcagaaatgcacgaattaagtgaaaagcaatttcatgcttttcgtaaagcacaatttgctagctatgcgatcaatccgttcattcgctttatcaaccaaatcgggtttgtcgtaagtgctgtgattggtggaatgatggtaatcaatggacagttatccatcgggttgatccaagcctacttgcaatataccaatcaagtttccgaaccgatcacacaagcttcttatattattaatacgttacaaagtgcattagcgtcattggaacggatctttgagattttggattatccagaagaaaaagaaacccaacaccctcttgcagtcccagaagaattgtcggggagaatcgattttgaagatgtttctttcggttattctccagataaattattgatgcaacatgtgaacctacaagttgcacctagacagacagtagccatcgtggggcctactggggccggcaagacaactttgatcaacttgctgatgcgcttctatccactgaatggaggcaagatccggatcgatcgctacaatatgacggatttttcagccacagacattcgcaaaaaatttgggatggttttacaagacacatggttgtttgaaggaacgattgcagagaatattgcttacggcaaaaaagatgcaacgaaagaggcaatcattgccgccgcaaaagcagcacaatgcgatcattttattcggacactgccgaagggctacgagacgatcataggatccgaaaccgaactatcacaaggtcagcaacaacttttgacgattgctcgtgcaattttggcagatccagctattttgattctggacgaagcgacttccagtgttgatacccgaaccgaacaaatgatccaaacagcaatggacacattgacgaaaaatcgaacaagctttgtcattgcccatcgcctctccacgatcaagaatgctgatttgatccttgtgatggaagcaggacaaatcattgagcaaggcgaacatgaggaactgttagcaaaaccttcattatacgcccaactctacaatagtcagtttgccagaaattgattagaatttttgtcacgtttcatctagagatcaaaaagcgaaggccatcgccaacaaaaaagactgcgtctagtatacagacgcagtctttttttgagattcattgactcatttcttcatttttccttggagatcaccaggtcaagaaagtaatttccggaaatgaattttttactttaaagcaaaaaaagaagaccattgccggtcttcttttaaaagttgttattatgctttaacgatgtttgttgcttgtaagccacgttggccttcttcaacgtcgaaagtcactgcttgaccttcatctaaagttttgaagccgtcgccttggatagctgaaaagtgtgcaaatacatcattgccatcttcacctgtaataaatccaaaacctttatctgcattaaaccattttactgtaccgttattcataaacgtatacctccatattacacatcgtgtgtgtttatttttgtaatagaaaatgatgtgtaattgaagtgcgtatcaaaagataaacaagtattaacatatcagaactttacttttatagaataccatgccagaagaaaaatagcaatgataatgctgcttttctttttcgatactcgtaaaaccttaagttttccttggcaacaacttttctaatcctgtctctagctcttttaccaccttattcctttcacatatcctttgcgctttgtagaatatttgtagaacacgcgacgcttttgcgtacataagaacatgtaaaatagcgaattctaagacagtgctatctaggctatggtttcaagtacaagattcaacgccaatcgatacttgcctcttgcagaaacatgcaccgaacaattcttttattttatcaaacttgtctctggaaactttaaggaaatttttagccttctttttattctagttctatttaaaattatttaaaagtaaaattatttaaaagttagtagagaaaatccccaatgactcgctgaaacgtaaattgattcatagatgtccttctcatccctgtaaagataatttccattaaagctaccttactcataaatttttctttcttgaaactggattatgatattttcagtaagaattgcttgatatttattaaatttctcctcatttatgttttttgtttcacaaactaaacccctctatggtataatcattttgtttttaagaaaactatgggcatacaaaggagaaggtaacatgaaaaaaacaaaaatcactttaatcgctgcttcattgctaatgggaggaactcttctagctgcatgtagttctgataacaatacaactgcaagttcatcaactgctgcttcaactgcaacaactgcatcaacagatgatgttgtttcaacagcttcagtaagtgaccaaacttcagtcattgaaaaagcattgagcgcagacggtaactggatcgttgctgttacagacaacatgactttcgacaaagatttgacagttgacggcgaattccatgacaaaggggacgctgcaaatgatatctaccgtaaatttgcattgtactctcaagatgaaaaccgtacagtaactgctgaatacactgtaactgttcctaaattagttgttaactcagaaaacttcaacatcgttaacggtgtagtgaaaggcgacatcgaagtaaatgcaaaaggcttcgtattgaacggcactaaagttgaaggaaacatcacgttcgcttctaaagaaattcaagattcagcaacacttgataaagaaggcgcatctgttacaggtgacgtgaaagtcagcgaataattttttactgttttctttgtgaaaaacactttcgaaaaaggaaccttggatttgattttattcatctccaaggttttttctgtgtttttttattctctgttttatcgttgttcccactaactttgtgtaagtagctacaaagattttctgataatctaaaaaattcctcccatcgtttttcactctgacgcacacttgccaaaaatgtttgacgataagaggattttttacttcttgccgattaactgcttaattcaatgctactcactcttcaatagaagcccatttgtaatcatattgcgcacctgcaccatgagaaacgactcctttgacttttggcgcccgcaaatgggcttccacgttttggtaaacaggaatgacaccttgttctgccataatgattttttctgcttctagtagatcttgccaacgagcttcaggatctcccgcatgggttgaagcagcggcattcactgctgcatcataatctggattactccaacgaccacggttataggaatttccagtaacaaacagatctgtaaagctgctggcatctgcatagtcggccccccatccgcccattacaacatcaaagtctccgttgttggaacgatctagccgaacagaaaaaggtaccggactcaagctgactttcacaccatccaatgtactttcgattgcactttggacatactcgatcgcttttttagtcgagtcggtatcagaagccaagatttcaaaatctaatgaatcgattcctaaagctgctttggctttttcccagtgttctttcgctttgtcttcattgtattcgatcacactgccagcatcttcaacaaaatctttgttatccgtcgggctgaaagtcataccttctggaatcaatcctgtcgaagctagagatccgtcccccagaatggaggatacaagtgcatcacgatcgattgcataagaaattgcttttcgcaaatcttcattacggaatggagaattttcttctcgctgattcaattcgatataagaggtccgggccaaaggctctgaaacgaaagcttcatcatttgccatttgctgcgccaattctcctgttaagatcacatcgtctgcttgaccatcttggaatagattcaacgatgtcgcagattctttgacaacactgacattgatggtttgtaatttaacattttcttggtcccaatactgatcattcttttcgtaggaccattccgtatctgtacccggtccatcaaatcctgtcaaaacaaatgggccattgtacacagaattatcactggtcgttgcatattgatcgcctttttcttccacaattccttgattttgcgggaagaaagatgggaaagcgagtaaataatcaaaatagggggttgctttttctaaagtaatctctaattcgtactcactgactgctttgatccctaactcgctaggatctgtttttcctgcagtgatcgattcagcattcttgactggggcaaacaaataagcgtattctgaacctgtttcggcttttactgtccgttgccagccgtaaacataatccgcagctgttacaggatcaccattcgaccacttagcatcttctcgcaatttcaatcggtagatcaatccatcttcactcacttctgcgagttcagcagctccagcaggttgcggcttactgtcagcatccaaacgatacaatccttcatagacattattcaatgcactgaagctgatcgtatcagttgcaagagaaagatctgcactaggcatttcttgctggacgacaacattgaagatctgttccgctgctgctgttccattcgaggaagtactttctcctgtgttactcgtgcctcctgtcgtacatccggctaataagacaccacacactgctaccaatccaaaggcccactttttcattttcctcttccccttaagttcataattttcagaattttctgaagttgaatttgattttaatcaataattatgataattgcaagagtttttcgctcgtttttttcaaaaaagattaaaaaaaaattctttttttcataaataattaatctacaacctttatgttctctttcaaacaagaaaaaactgtgatacgcaagagcatcctatcagctccttacgtatcacagtcaaacaattatcaagcttccattttgtagctttctctactattcttacgatctcttatcacactaagaatcgtagggatcgcaccaattgcagtaaacagatagacaagagctaggttcccatagtattgactagcttccaaataaccttctcttagcaagtcaggcaatatccgaaatgcatagaaataatcaacatcggtataataattggctacactgatagaccaatcaatccgattgcctagataaaccatgatgaccataatcaaaacactaccgatgatgcctttgttgctcagctttccgccaagaagttcatacccttttaaagcacagccagccattgcaatacctgataatgccgctacataacctaattggccaagtaaaataatgacaccgaccccaatcagtgaacctataaatgcaccaactatcccagccagccagttttctttcttctgattctgctcatgcaggctagcaagcatcgcttcattttgctttttgaaacaagcactgcaagcgatcactggcagcccacctatgctgtaggtatctatcggcgcttccgatgttccgcaaaactgacagactgtttgatagtgattttctttaagaaaatcagtgactgtatctagaccagcaaccaatttttctttggttttggcaacagtcattgcccctcggaatgtataagtgacttggtaaccttgtacagagcagtccaatatgtctttggaatcagtcactacttgtctcacttgctctgagctaggtagttcttggtttttgctgatcgaaaaagttgctgcgaaagaataactattattattcaattgtgtcaatataactttatacgaacgatacgtaccgtaaatcacacccatttttggatctaccgacaaccccaacgtctccgcaaaactagataatgtttttacgagcttcttattcatttgtcctccttttaaacgatagattataacaaacgttataactttgagtgtaaaatagaggccaaaatcgtgtcaaaagatacgtttgtgtattttgtaacacgatttgttttctttaagcgattcccgatattaccatctgctggccttcaggaagtgatcgataagacaaatttctgaagagcagctgcaactccactgtctttatttgaaagtgtaacggcatccgcctgttccctgactcttcgtggtgcattggccattgcgacccctactccagcttttagtatcataggtaaatcattgaagttatctcctattgccaacgtttgcgctagaggcacgttgtaataagaagccagttccatcaatgctttttcttttgaaacttctcgatgcgtgacttctaggtaattatcttttgaaaggtaaagagcgctcgtcttcaaagattgcttttcccagtaaccttttactttttggatctcagcagacgtaccgatcaaaagtaatttatgaacgggtatttgcaaggactgtactaaggccaataaatctgcctcctgcgctacctcctgcgtgattgtggcttctttttttacccattcatcaagacgatccacataccaaactgtatctgaataaagattgatagaaacttgtgagaagtgtgttcttgtctcgctgatgattcgcacaacttctttgatggcaacttcatgacttgagataggcggagcagaaagatttccgtttgccagaactaacgcgccattgtaacaagtcaaaggatactcgctgattcctaacgcttcagctaagtgctgcatcccttttggtgatcgtgcagacgctaagacaaaaggaattttactttcttttaatcgttgcagcacctgttgtaagtttgggtcaatctgatgggtatcatctaaaatcgttccatcaatgtcgcttacgattaatttgatttctctcgtattcatttgtgcctcctaactttagctatgactttcattcgactatcttcatcctcaaattcgcctaaggatgaatccaattagcgtgattttttgattcgtaatgcttgattcttcgctaaataaaatggacgcaaataagcgactgtgtttgataaaagtagaacatcgggagatagttggatgttcaagcagttttcgagatattctttgcgtttcgtgatacgttcccacagttctggataatcggcttttaattcttgtcgcagttcttgatcagctaatgcaatacattcttccgcactgacaccagtatactcaggaacagatggaatgatatctacttggaacatcatgccgctttctaaaggtgtaagagagtccgcgtagattggtgaagacatccactcatcatccgaaaccagatgtccaggattcaagtgccagtgataactcttttttggcagaacttcttcaatcaatcgatacatctcgccacccgtttggttgattcgaattgcttccaaccaagtggtgatcgcctggtaatacggtttcacgacacgttcaaggtaatcttgttgttcagccggcaattgacttgcttctgagacgacaaatcccgtgcgactggagagtcctcctttataaccaatcgtcattgagaaaggatcacccaaagcaattcgtttgtgcgttggataaagattggcaaattcaaatcgtttaccgctagcagcgattggcaccacagaaggcatttgtccctctgccaacaaatatgccccaatttcggcttcttttttgccaacttcaatcgcattcatcgcactcaaaatacaacgagaagaaaggttagccccatattcataatgagcgatctcattggcattgttgtgactacggcttcctttttcaccaatcagcaaataagcagcatttaccacatgacatgtccttgtgactgcccgtttgactgcatctacgataaaataaggaacatcaaagagtgtggctggatcttcgtgatgcgtcgtgaacatcttccacccaatgatgccaatttttttcttctctttaaaccttaaagaagaaaaaacagaggatagtgatttttctcctgtcataggctgattcggcagcgaaaactgcgggtaatggactagctctgccgctatgcgggaatgagcctgcagctttaaattttcatttcccaaaatgagtgttgcggcgccagttttatctagaaccaatagtccttcctcgaatcttggcaggaatcctgacagatattcaaagttgctgccatgttctttgtctgcatagatcaccaacgtgtcaaactcttcagcagccattcgctctaagacacttagtttgcgctgactcatggtcgcatcacttaaaaaaactggagcgacctcttcaaaaataggtggttctggtaaaatggctaattcaatcgcttttttcatgattaagactccttctgatttactctgttacataaatggtcacattcgctgcggcaagtgctgcttgtaactcgatgtctggttgttgatcggtgattaaaagatcgatctccggcagatcacagactttaaaaaaaccagtcgttgctaactttgtatggtcagctactgcaatgacatactctccttgtttcaccatctgacgcttgaccatgccttcttcttccgtatggataaatacgccttctgtagaaagggcaaatactcctaacagtgtgtaatctgcctgaaattgggcaagtttggcaacagtatccgcaccatataaaaataattgttctttgtctaatcttccaggcaaaaccgtaatcgtactctgttttagcgctgccaatcgttgggcatgagtcaatgaattagtaatcgcttgaagaggataatctgacagttcattgatcaccgcttctacagttgtcgatgcatcaaaaataatcgcagctggctgtttgatccaatgaatagctgctttagcaatttttgcttttatgtcataaaattgcccggcgcgagtttgataatcataaatcacggctgcagggttcgtcgaaaccgcccctccgtgggttcgtttaagtacttgccgtttttctaattgaatcagatcacgacgaatcgtatcttttgatacggataacaacttggacaatcgttcaatcgaagcactttgctcaactgctagcacttcttggattttagctaggcgctgttccacaaacatctctctgtcattcctttccactaaaaaatacaatgcaaaaaattgctaaacaatgcaaaaagatgcaaacgatcttaaaaaaactacctccaacaaacatgttgcaggtagttttgtcgtcattgttcttcttattttacacgaagcgcaaagctggctgttgaaaaacctgaacttgcttcggtaaccgtgtacccagtgcttggtgcatgaatgaagctgccgttaccagttgcaattgcaacatgatacgtattgcctttttcaccccagaatagaagatctcctgcttgggcttgagatacagggatgatcgtaccggcactttcttgcggaacggtccaatcgccaatatttttccctgttacttgtaaaaagacataacgagtgaaaccggaacagtcaaagacatctggccctttccctccccattggtagggtgtcccgatatatttacgggcttcagctacaatagcagcaccgttaatattcgtaccgatagtattgttgccagaattgccaggatttgttgtggtatttccactgacttcttttacgtaagctgccgtgatccagccaccgctagataacttataccacgtcgtattaccattgacagaagtcccttttttctgcgccactgctttcactacagcgttgctgctcaaactgctgacaatactggcagtagttgaagcgttcgaacgaacattcatcccagtcgtagtctgtagatttttactgattgcttgttcggcagaattatttgatgaattagaattattgctgcttgatccaccggttgatggactgctcgtattgctcgcatctttgacataagctgccgtgatccaaccacctgtagataatttgtaccatgtcttattgccgttgacggatgaacctgatttttgagcgacaactttaacggtcgtgctattgctcagacttcccacaacactaccacttgttgatgcactggaacgtacattcaatgaagcggtggtcttgacatttttgctgattgcttgttctgtagttgatgtgtttccaggattgcttgtcgttgaaccgctagacacagcctgaacataagctgcggtaatccagccaccattagacaatttgtaccatgttgttgtaccattcacggaagttcctgatttttgagcaaccacaatgaccgtggcattgctgctcaatccccgaacgacactcgcactggttgatgcactagaccgtacattcagtgctgctgttgttttgacggtcttattgacagctgtttctccgctagtactgttgttggaagagttgctgttgctggcggttgttacataagcgccagagatccagcccccagatgacaacttgtaccacgttgtgttcccattgacggaagttcctgatttttgagcaacagctttgatcgtggtattgttccccacaccgttgataattctcgcactggttgaagcgtctgaacgcacattcagtgaagcggtcgttttaaattgtcgattgatcgttgtttctgacgatcgagcaagagttgtcgttgcagttgatttagttgactttgctacttctgtttcatttactcctgtagcgttggcctctggtgcgttgaccaaagttgtgaatacacctgatgtagaagctaacaccgttgtaacccctatacttttttgaataaaaagtgatcgtttttgtttcactaaacgcttacggattgcttttcgagattccaatgaaacaccccctccttttcattctatcaaaatcgattgatttttaacatcttttttctgtctgtaacatttatttaatgtaggtttattccttggcaccgaaaaattttctttctaaacccacgttttacctatacaaacgatacaaatacaattctattttaaatgaaaaaaatatagaacgctatcaaaacgaatgaacccgactgtttttttggaaactagagtagctcctatcaaataaacaaggtaggccaattttcttcaataatcctgccatctactcgacatttatttgcaatctagtccttttttcttcacaaatactattttaaaaagcgttaaagctttaaaaacaaaagagaaaccgttttaattctttgtgaaattatgctatagtaaaaaaaaggaagaggtgacttaaaatgaaaacgaaatcgaaagaaaaagtttatgccgagcgtcagcatagttataagcaagaaaaagaggaaattttcaaaaaagcccttgcttctgtaccaaaaaaagacaaaaaatccgccgctaaagacaaacgatgacccttatctgcctgcgacatttactttaggctgctttgtagcttgaaaaacatgcctgactattcaaccgatccgagtagactctcggttcggctaaataatcaggtattttttgtgtcgttaaagctttaaagatcccgtcattcctttgacaaaccctcgttgcataaagagaaaaaggactaatgtagggatcgttgcaatgacaattgctgtcatctgcacgccatagttcgcaacataagaagccgatgataagttcgatatcagcaacgtcatcgtttgacgatcttctgtctgcaaaaagatcagcgggagcaaatagctattccatgagttcataaaagcatagatagccgctgctgcataagttgagcgcatcattggaaaaacgatccgaaagaaaatcgtatactcacttgctccttcgatcctgctggcatctaaaatgccatcgggaaaggacttgaaattttgacgaaagaaaaaaatcaggaagagattattgactagcggcaaaataacggcgatatgctgatttacaagatgcaggcctgacatcatcttaaacaatgggatgactaatgcagccagtggaatcatcatgcacagtaaaaaaagcgagtaaatcatttcactgctgcgggttcgaaatttctcaaaaccaaatgccgccaatgatgtgatcagtaaactaaatagaacagtaattacagaaatcttgatcgaattccacatgatcaaggaaacattatagttagaaaatagttgctgaaggttcgtgatcagctgatttcctagtgtgagttttccagcagcaatctgattcgatgtattcgtcgctcccgcgatcatccaatagaaaggaaagatagagacgaatgccgctacgatcaaaaaaagatattttatcagtgtattcacatttcgcttcatcgctgctcctttctgcttattgtcggtcgtcttttgctaatttgaactgcgcataggataagaccgcaatgagcactaccaacgcccacgacaatgttgctgaataaccaaaatttgaggtatagacaaatgaatgattgtagatcagttgtgctgcagtcaatgtcgcatttgaagggccaccgcctgttaaattcaccacttcatcaaagagctgaatcgttccgatcgtcgatgtgattgtggtaaaaacaatcactggcttcaattgaggaataatgatcctaaagaacttctgaaagctgtttgcgccatctatatccgcagcctccaacgtatcatctgaaatattttgtaatcctgctaaataaaaaatcatgttataccctgtccagcgccagcataaggcaatgatcaccgtcactttcgcccaaaaagggctatttaaccagtctaacggttgttggataattccaattgccagcaagccccgattaatgatcccaccgatctggaacatcatcttaaacaaaaccgcataagaaaccagagaggtgacacttggcagaaataaggcaagcttaaaaaaagttcgtccaactagttttggtgtattcaacacaaaagctagtaaaagtcctaaaaacaccatgattggcacttgaaaaatcaagaaaacaaaattgttgaataatgctttgtggaaaatggtatcttgaaacatccgaacgtaattgcctaaaccaacaaaaacggattgcaatccttgcatcgtatgaagagataaataaattgaataaagaattggatagatcatgaaaatactgcttaagatcattgcaaaactaataaatttccatacttctcgcctttttctcgaaggatccatcttattcactccctgctaatgcaaatcggctactcgccgacttgcattgtataattattttcggcttcttctagcatttcgtccaaactcaatgcatcatcaaaataactctgcataactcctcgaagagcatcaaccgctgcttgcgtattgttgccatagtcgacaccagggatttcagccatccaactcgaaaaatctttatagatgggcgcatcattgaaaaatgggtctttgtattgatacgcatcccctttttgagatggtaaatacgttcccactgccccattctcgaccaatatctcttgataaaattcatcattgcctgcaaattctgtcttcaagaaatccattgccagttctttatttggcgaatcgttcaaaactaaccagcttgatccgcctaggtttgaatagggggtcgccccatcaactgtctctaattgtggcagatgtgtataagcccacttgcctttttgatcctccgcggaacgaatcgttgctgaaaaccaaatggcagaattaaccgccgcgacttcaccactcgtaactgctccgattccctcaggagcaaaataatctaccggttttgctaactctttctggtcaatctcttttaggatcggcatcatttcgcggatcgctggattgtctttcaagaaaattttgccctcttcatcgaaataccacagtccggcagactgcatcgccatctgcagataatgggtcccacggttgggaatgaatgcgacaaaccatttaccggtcttttctttcacatcttcaccgatagtgacaaattgggaccaagtcaaatctttcatatcttcttcactgtagcctgcctcacttaaataatcggtgcgataatataatccggcagaaccagaatcaaatgggactgcatagattccctccttataggtagcattctctactttgtattcggcaaaatcagcaaagtcgatggtatcagataactccgcaaatttcccttcataattcgtaagataactttgtacatcataatcatccatcaaaacgatatcaggcaatccttctgatacccccgacgtgaatccagaaaccattttttgctttgtgtcctcattcgacatttcgatgacattcactttaatctcatcatgcccatccttacggtagtactcccctgctttttccataattggaatattgaaattcgtatcccaagcccagacagtcaatgtctgctcatctgaactagcaaaatctcctgattcactactctcattattactggaacaaccaacaagcaacgcaaagctcaatatactatatagaaaaatcaacctttttttcatttttctctcctcctatttgcttttcctaaaatcccagcaaaggtgcaatagaaagcgattgcaccttgcttttattatagatatcagatgaaaaaaaccaaataattgaatttctgttgataaaaatgaataaatttgagccatgatgaatggaaacaaaatatgaaagaagtgcagaacaatgagattaaaatgagaaaatgatatagtagtgctaacatacaggaggtgagcagatggtttttacgattattctaaaattattctttgggttatttggcttattgttggtggcaagactgttagggaaaaagacactgtcggaaatcacacctttcgacttgatttatactctcgttttaggcggaattttagaagagtcgatctacgatgacaacgtttcggtcttccatgtccttttcgctatcgctttgtgggcactgttgatttactttattgaagaatttgttaaaaaaaatgagacaatcaatcgctggttgaaaggcgaaccggcagtcttgattcacaatggtcagctcaatatacaagagattacccgcaatcatatcgaaatggagcagttgcgaaccatgttacggcaacaacaatgtttctcccttgcaaatgccaagtatgttgtactggaaaacgcggggcaaatcagtgttttaacacattcagaggatgagcaaacattggcaatcatgctggttgaccaaggaaatattcaatatcctgtactgcaatcccatcatttgagcgaaacttggctacgagaagaattacagaaacaaggctattcttctttcaaaaatcttatttatgtagagtggtcccaagacaatgggttttatatcatcaccaaggcagagacgatccaggctcgctaccgaatcgatggctaaaacaatcattcgattttaagatacttttcctctttaggaagatgccatcaggaagataccatccatcaaacaactattttcgacgagtaatcacttagcaatcagcatgagcaaaaaagacttactttaaaaacgttattttttcctcactgcctcttcatagagatttctttgttttcttggaattttttcagatgaaagaagtattctactgaattagatggaggtgaagggatatagaggtaattggtggattgattttttggattcctgttttattgtttcttattatcggatcgatatttattacatggcgaaagaatgtcgttgtactactctttcttttgataccatttttgttttttttactaaatgtttttgatcatcatcattatgaacccatgtctgatttgatgtacaatcttttaggactagctctttcaacgattgctatcatcttttatttgctttttcaaagcaaaaagaaatagagtctatgccataagatcttcgacaaacggatatcccatcggtgacgatgtcccgttgtactccagtcgaatcttgtaacaaaagagcgatgattcaacgatcaatcagatgttttttatttttactaagattaaataagtgaacgaatactcactcaaataaaagatatcccaacaatgagaaatagttagcccgtcttcacgattttatcgcgagtattggctagctactcttaggcgggatatcttttttcgcttgaatcttcttatacaaagcagaactcaattttttcactagggccttagctattgctataattgcaggcaactagtccacttgttcgatagtcgttgtcccccagttcatgacatttgcaacatggacatacccatcataaagatttaacagcaaagcgattgcacagacaatataaacaagtcgataaaaagaatttgtcttcttgttgcgccaaatggcaaaaccgcttaggaggatgcctaaaggaaagatgaatgaggatacgccggctaaaagcagcaaaatcaatccttcatctttatcagaagacatttgttgggtgataaaactcaacttcttctttttatcttcaatttccacattattcttttgaatttgttctttcaattgttcattttcctgcagcaattcatcaatcgatacttgataaagtttgcttagtaaaactaaattatcaatatctggatagccacgcccattctcccacttagagatcgactgacgagaaatctttaattcttctgctacggaagcttgcgacaatccgcttttctcacgatataattttagttgttccgctaaggccactaatttcatctcctacacctattactttacaactagtttaccattagaaatggttgcggtcacgcttgcatttgttgtaatcgttccagctttttgtttaaagctgcaagtagccttagtagtcgtatgggttaatgaactcgaaagaatacttcctttcaatgctttgatgctcaaatttgtcgccgctgtgatctgttcttttgagttgatctttacattataagaagcagtccaacttcctttgactgtcttagacactttataagttccttgagcaattcgtgcaaagggttgaatatattcaacagatagtacgacttcatcacccgcttcatcaatataagatatctcttgagaaccgacgccagcggtcatttcataaacaagctcatctgtattcttttcatccgctgcagctgtgacagacacccccaaaaaacctaaaaaacaggctactaaaataactaatttcttcataaaaacactcctctcttatttgttttcactttatcgcttttcttgaaatataaggagaaactataggtttacagggggaaaccattggtttacatccttcatttccctttcattgtaaacaaaaggttgcttcttttctataacaattactgtaataatggaaaagtacgatctgtggggaggtgtcagaatgaaaaggcaaaataaaatcctattattcagttttagtctgccgctttttagtgtttttttcggtccagtatctagccaacaatttggtcccttgtacgaatatgcttttggcttcccgctaagattcatctggtataggagtatcaatgaacctcttgaaagtcattgggcactcttttcctttgaaaagatcgctcacttgcaagttgatttacttggctactttcttgcagtgctgctgacttatctcgtttcccgatttttgttcgagcaactctcacaatggctgcataagcatgtgcaaagcggactattataaataaaaggaatgttttcgttaagaggataaaccctttctcaatccacaaagacaatacgacctcaagatgtcgtaggcgaaaacaagttccccctatatattgtggataaaactgttaatatgtgcataactcggtctttgacacgctgttttacgaataaaacggcccaacaagtatccttttcacagataaatgttgggctggtatcttaactcatcctcattttccagcagaccttcgcaaaaaattttttgccttgctgctaaacttatttttgttattcgtcattctcgtgctatccatcgatctctttcagtgctgctgacggcacgtcttctttggcaatttcttcatacgtctcaacatgtgcccctttattcgtcaatttcaaaaagcgctctgtcttcaacacttgtaagccttcaaattctatcattcgagtctggccatctgccgtggcagctacttgtttgtaatgagcagtgccatagccgttgaccgattcaggcgcttgcgtttttacatacatttcgctttttggaacaagtggattcaattgatctaaaattcctgccacctctcccgatgctcggttagtgtacaacatgattcccccgcacagaagtaagaaaaacaaaccaattgataagattgctcgtacgatttttttcatcatattctcctttcgtctctctttctatcttagcaaaataaaaacaggggaaatcggccttaggtcccaatccaaaataacaaaattgaaaggttgccgtaagaaaacttctacaacttattgatatttgcttaatactgcttatccagctaggcaacaaaggcaaaaaagattacaataattaaaaaaaggagtacctatatgcttacacatttcaatcttattgctattcttttggcaacacttgcttttatgatcagcgggagcttactttataatccaatccatgcttgggggcgcttttgggcaaaagaatctggcatgctaaataaagaaagtcatcatatgtctgccggcgatgtcgtttttacttttggcgggacagctgttggcggactattattggcatttacactaggacaagtcacctattggttcaatacgtttgaccatgacggttggatgatgacgagcttgcaagtggcctttttgctatggctgggcgtatttgctgtggcaactttcgtaaatgcagcctatgctggacaaagcaaaaaactgattggtctgcatttattgaatggtgcaatcgagttagtcattatgggaatcatcattggcttgtttccagtggtaggttaacaagctgatacgcaatcataagcaagtgtttctcaagctatcgggggcagaaaaaaacaggtaatgtaaaccaatcagtgaaaacctgtcgtaaggtatgagtgggctagcttgtcgttttttgattattcttgggccaaaaaaagaaagaagggatcaccatcaactacctgcccaatctcttgtccattgcacggatcgcgttagctggtcttctattgatcaatcagcagcctttgttttcagtctgctacctcatttgcggattgacggatgttttagacggatttattgcacgaaactatcgattgcaaacgaccttgggctcaaaactagatagtttaggtgattttgttttttggtccattgtcctatttctttacattaaaactaagatctatccagattggatcatttatggcattgtcttagtcgctagcattcgatttcttaatttgattttgactaaagttaagtttgctcagtgggggatgctgcacacattgagcaacaagataacaggtcttgccttgtttctcctgtgtttcgtggcatttacttttggtgacgtatcaggatatatttgggtcgtgacattcctgctcgctttgttttcatctatagaggaaacactgattgtctggcgcagcacttattacgaaccgaatccaaaaggctttttcactgtttctcatcaatccagctaaattttagcaacaagagtatcaaaaaaacgtccagctgtaataagagctggacgttttttgcgtactatctattatgaatagtaatgtttatttattttttagcgtattctgaagcttggacccctgcttgacgaccaaagaccatgatatcagcaactgcatttccgccgatacggttttgtccgtgaataccaccagttacttctccagcagcgtataaaccatcaataacagaaccgtcttttttcaagacttgtgtattggtattgatttttacaccacccattgtgtggtggattcctggtgcgattttgattgcatagtaaggaccagttgttaagtcataatccattgctgtttctcgaccaaatgcttcgtcttttttatctttaacagattgattccatgtatctagtgtttttgccaatgtatcagcgtccatgtcgattttcttcgctaaggcttcgatcgtatctgcttcaacgactacaccttgttctttgtagaaatcaacttgttttgctcgacctgctaatgcatcgtcaaagatcaagtaagcatagctttctggaagagcggtaatcgccgcagaaacattgtcgcgggtttctaattcgttgtagaaacgttcaccttgttggttgactaaaatcgcaccttctccacggactgtttcactgactaacatccctgtatcttgaacaactgttgggtgaacttgaatttgatccatatcgactgttgcaccgccaagagattcaatcatcttgataccgtcacctgtactgccttcagatgttgtgctgacatagccttttaaatccggacgatatttttcaatcatttctttgtttgagccaaagccaccagtggtaacgacaactgcattcccattgatcgttttttcttcatcaccgatttttacagaaacgccagtgacttttccgtctttttcgttgattttcttcacatcagcattcacaaacaaaggaatttccttttcatggatatttctcaatagtccatctaccaagtaggttccgacagcagagccgtcatgtggacggtggatacgtttgacacttgcaccaccactgtagctgatgttgtctaatgtgattcccatgccgtctaaccagtcaatggctgaagctgagttatcgactaagtagtgtaaaagttcttggtcattcgtacctttaccaccttttagtgtgtcatcaaagaactgttggttgctgtcttcgattccttgttctttttggaattttgtttcagaagcattcatcccaccagaagatttcaatgtgtttccgcctgcgatcggcattttttccaagatgactggattcatcccagcttctttggcagataaagcagctgccattccggcaccaccagcaccaacaatgacaatgtcatattgatcttttagttcagaaggatcggtatattcttgttcagatgcacctgaagccacttctgtttcgcttgatgatgctgaactttttgctgtttcactatcttttgtcgccccgttactaccacaagcactgagcaataataaacttgcagcgccaatgaccaatttctttaatccacttgttttcacttttttcccccaactttctttcttttgtttgattgttctttgattcttccactgaaaaagcagcgctctagcactattgattgttactttattaacaaacaagaataaaaaaatattttgactattaacaatttcaattgctttaaaatcagcgttatcatctaaaaaacaaacccaacatatttatataaacataataaaaatagaaaataataaaatcacgcttatattttgtgtaatttttcattagttgttctaatcgaaatttcatttactgtgtatatgtccccattgatcagcggtgcatacatagaaatatatacacaccgcaggcaaaaccttaggaatttttctttgattgcttctggtcaaaatttatttgattgcttctattctttacttgccaactgctagttgcttttttggaacgataattttctacatctttattacacagaaatatccttagcgctttcatgattttcgaaaacggcactgactacttgttgcgaaaaaacaatcacattctcctgcaagatgtgttctcctctgatggattcgattttctttgtcagacgttcaatctctaaactgtcgatcgctccactcatgtagattgccgaacgattctggtaggtgtttgagataatgatgtctggctcttcaactagtgattccgcagcaataaaatcaatattataaagagcggagaagatctttttcagctgcataatgaagaactgttcaaatgagaaaggaaaatctgtttctacagaaacaatgatctttttctcaaataaagtaggtgtgatcagagccgtgtaggcaagaacatatcgtaagagcagaaactcctgtttttctgtaagttgccctgttgtgctgccaaaacaaatggtacgtattttattcacaagcactgggtagtagtgtctgtaatagcggatgatatctgaatcggaacctacttccaggaatccttcaaaagcgtcataaaaagaatgcaccgccaataaaatgccgaagacatttttctcatttccgccatttaacggcaatgtcaatttttctgagagactgactgcttctaaatacacctctgctttttctctttcccaaaaatcgatgatttgcttataggtcgcctttttagcgtaaaactgcgtggaagtttgcatcatcaaaaatagaaaataaatgctttcatctctaaaaaagctatactgaaagaaagaatctttgatattttgaaactctttttcaaatagatcttgagtcatattgatcgaccattgaggcatttcctccattttcaagcggttgccttttttatctctgaggatgttgatcgcaatcaagtagcaccatttatccacgatcgattgcttcagttgaaaatcaaaattaggtaagattcgctgaacgaataattctctgatatgagcataattcaattcggggtagggccactgaccgcctttacaaatcgtccaaaaaaaggaatgaccaaagtaacgaatttggctttcggacccttcaatcacgattcgtctatttttggtgcctatctttaattcaaagcgttgcagactacggttgatgcaaagaaatttttttcttaggtttgaaaggcttatgtaattcaattcacaaaactcttcaatcttaattctttttgacaatagacagttctcgatcacttgatatatgactgactgattataaatttcatgttgtatatcaaaataaatgtttttattgccactaaaagagcaccctaatgcttttttgattttgattgcttgcggattgattttttgcaattcattaagaatactatccgttgtttttcgattcacattcagtctttctgataaattaacgattgttacaaaactatttgactgataaatataacgcaagcaattgaccattaattgggttcgcttttcaaaaagatcctgaataatcatgtcttcctcctgcattaaatagaagttcgttcataagttgctttctttcatactcatataaactgacaaaacgattaaatatatatattaatttttaatctaattttaaacatttgtcgaataagtcgctcattcttcatctgttctatgtagtgcgactcaacaaaggaagaacgctcaactttttactgttataaaaaaaggcatctgactgccttctctgaccttaattctgtaattgatcctccctactacttaagtgcttcctttcagccatcaatttttaatgagaatttaactccactaactaaaaattataaagttaatctgtatcttgagaaacccaattcgggaaaatgaactcacttttttttacattgtcactagaaatgttttggcaggaactcctataaatgcaggaaaattattgttaataaagacctttttatcgctgctttcggttagccatttactgacgataattatccatgtgatgcttttatactttttcaggaaaaacaaatccccctattttatcttacacaagcaaaagagaccttcgagaatagccaaaggtctcttgaaaaaattattgttgatgtttctggactcatcctatacgaacgttcttgcgagcggtatatattttaagatgatttgcttcgtgttttttttaatgctttaaataaggtgtgatattggcctttaaaggacatggcttgttcaaaaatatcttcgccgtcattcagcatcttaacagtaacccaacctaaagattcagtaatagcactggctacccccgcgttaatggacgcgccggcgatcgtaccgacccccggtacgaacttgataatattccccacagcgcttctacctaaactaacaacaactaattctttagaaatgctttttgcgattccctcgacccacgattgaccaaacaacttgtgtagtctagccatcatcgtcatttgaacaggtacaaggagtatcgcatctgaaaacggaataggtgaacaaccaatgatggccgccgtcagagaagcggcatggatgattcgatgcgctttcttcttcgtagcatcatccacacccattaaaaattcagagaagacggcatcaaattgggtacggctttttgcttggatcttttctgccgtatgttttgacttctcaaaagatcgacgaatgatccctgccgttttgtttggtagtttggttaaaacttctgcaaagaatgactgaaactcttcttgttctgccgattctttcactggttcatccacttgttgcagcaaaatttttttttgagattttttacttttgggagtgtttctctttaatttcataaaaaccacctttaatgattagttgtcatagatttagttgctttctcaacctcttattttcatcatacactaacaaacaaaaatcacctaaagccgcgcttcaggtgttataattcttaacggaagcacaagaaatcaacttctttctaacaaaaaagctcacatgaccgatccaacgataccccctttaaacgagagtctctcccgtggtataatgactacttgtttcttgggtattatgaaagtgtcataacctctattcagagaagcatgtctaatcgagcgtgttttattcatataggcagcagctgctgccaatccccacaacaaatcatcaattgataaggagaaaacaaatcaatgacctatgcacttgaaataaaagatctaaaaaaagtctatgcgaccggcgtcgaagcattacgcggtatcaacttgacagttgaagaaggtgacttctatgcgcttttagggccgaacggtgctggcaaatcaacaaccatcgggatcattacttcactagtaaacaaatcttctggcagtgtcaaagttttcggttatgatttggacaaagaattggttcaagtcaagcaacaaatcggcttagttccacaagaattcaatttcaatcctttcgaaacagtacagcaaatcgtcgtcaatcaagcgggctactacggcgttcctcgcaaagaagcgatcgctcgtagcgaaaaatacctaaagcaatccaatttatgggagaaacgcgatgttcgggccagaatgctttcgggaggaatgaagcgccgtttgatgattgcacgggctctgatgcacgagccgcgactcttaatcctcgatgaaccaacagctggcgtagatatcgaactgcgccgagaaatgtgggccttcttgcaaaaattaaataaaaatggtacgacgattattctaaccactcactatttagaggaagcagaaatgctctgccgcaacatcggaatcattcaatccggtgaattgatcgaagataccagcatgaagacccttttgtccaaattacagtttgagacattcctctttgacttagatacctatgtgaaaccacctgtgatctccggctataaaagtgcttttgaagatgatcaaacgttagcagtcgagattgagcgcaatcaaggcgttaatgatttgtttgagcaatttactaagcaaggaatcaaagttctttccatgcgcaacaaatcgaatcgtttagaggaactttttttgaaattaaccgaagaaaagcatgaagcgggggaaaaaaatgtttagtctttattttacagcattaaaaagtctagcggtcaaagaaaccaaccgctatttacggatttgggtccaaacactcgtaccaccagtgataacgacttcgttgtactttattatttttgggaaaatgattggcggccgtattggcgaaatgggcggcttctcctacatggaatttatcgttcccgggctgatcatgatgtcaacgatcaccagttcttacgcgaacgtttcgtcttctttcttttctcagaagtttcaaaagaatattgaggaacttttagttgcacccgtacctactcatgtgattatttggggatttgttttcggtggtttgggcagaagtatttttgttggtatgctggtcacagtgatttctctcttttttgttcctttgcatgttttttcttgggtaatggttattctgacattagtgatgaccgcaattcttttctcactagctggtttgctaaatggtatctttgcccaatcatttgacgatgtatcgatcgtgccaacgtttgtcctacagccactgacttatttaggaggcgtcttctattccatttcgatgctgccaccaatttggcaagctatttctaaagtgaatccaatcgtctatatgatctctggattccgttatggctttttgggcacaactgatgtgccgattttagtctctgttctgattctagttttattcataattgttttgtacggtatctgttggaaattaattgaaaaaggccgcggtctacgcagctaagaaactgacggctatctttcaataaaaacaggaaggctgtgccaagaactctcttagttcttggcacagcctttttctaattctttttgccttgtctttcgggactgacccaaacaccgctgccgtgtcccaaaattgttttgaccgctggtatgaaggtcgtaacgatcgttaaagcattgaccatccaataaatcagcatataaaatggtgcaaaaatgaaatacttgatttttctgccagcatcgtccaccaataaactagtcaacaactgcatgatcccagcaaccatttcaaaacaaacgaataggaaggccattgtcaccatatgatacattcgttcaatgtttccttcgaatgcaaaacgaagaaaagaaaagatgaacagtactgaagagatccaaaagaagatcgaccaaataatactcaatgtttgatccacaaacatgacggaccgaccaatattttgaaatggatgagtgaatacttttttgaaatttgtcagccagacttctgtaccgcctttttccaacgtttccgttggcgataaagcatcttcatggtctcaggaacttccatgaaaaacatgatccgcggagcaaacaaggacaaccagccttggaattggtgatcccaggcaatactgatatcctcggtggcacgattttggcggaagagtcccacatcgatcaaagcattttttcgatacatcgtgttggcaccgctgtatgcatagataacacctagcacgccttgttgcgtccgcttgataatacctacgatacttgaaaattcaacagtttgtgacttactgacaatcgtcgttcgattctgaacgtccatgtttgcagtgatcgctgaaatatttaccgcatcttggcgaataaagtaattgacatatttccagagtgcatcgggttccggtacagtatctgcatcgttactcaaaatcagttctccattagcaaaaccgatcccgatattaaaggcatgggcttttccttggtttttttggatgcataccactcgtagattagggtaggtttgctgcaaacgcttaaggatttctggtgtttgatccgttgagccatcatctgtgactaacacttcgtaacgggtataattcagtttattcattaagtaatgaatggtatctttaatgaccacttcttcattatgggcagggaccatagtcgtgatcattggctctacttcttcgggaatggggatccattcaatctgttgatgcttaaacaaatacgtatgacaaaggacgccaatgaaccaagcaaagccgcctaagattggataagtaaataaaatggccactaatagaaaaaggaagaaatccactatcgggtatcccgtatcgatttgttcaatcatagagagacccccttatctttatacaactttactatttctgtttccgttagattttgttccggtttcacttcataataacaaacagaatgccgcatctcttcaggaccaaaacggtcatcaaaaaattcttccaacacttctttgcgctgttcaagttttctttcatcatgcaagacttctttccgcaatgtatggcgaaaacgccgattgttcctcacggtcaacagaacaaaaagaataactaaaagaacgaaggaaattcctaaaaacaatgctaacaatctaaaaatagtggcttcctccacataggtcctaaatcgtatttgagcggctgtttgcggaaagaaaaccgggaaagcgacccaaacgaatggtacgatcacagcaatccacgcaagcagtgtcaaaaatgattgccacaacgttaactttaaatgtcctttttcaaaaaacaaatctgaaaccagctgttgactgacttcttctctggtgattctttttttcatcccacatcctccttttggctgtaactctcttctccatctatacatcgcttattactaaaaagaagcatcaaccctggtagcggtcacaaaaacacttaatcaataaaagctatatttgacctcttgtaggactaggtctaagcgagtatacctacattttagttgaatcgattcgaaagaaaaagaaactagcttgcgccagtttccttgtgatcctattcttttaattcgacttcctaaaaagaaaaccgctaacaacaatttcaaaagttatcaggcaagtccatttttttgaacacccacgaatcttgctttttagtaccctttcatccagacagattctaattgatttccgtccggatcaagcacttcaaaaccaagcatttcttcctctggaatccccatctctacttgaaacgactgtcccccattggcttcagccgctttagcaaagtctcgagctccttcaggtgtatcaaagctaaatgcgatcaaggcagcattcgtcttttgcgtatccgcaatctttctaccatttaaaaactgttcataaaacgcatattctgacagcatcacccaaatcgtctcattccacatcattccacttgatgtttcattcgaaaattcttcattcttgctaaagcccaacgcttcataaaaactagtagctcgcttgatatcttgaacaggcaaattgataaaaaccatctttcccatgctgtttcctcctttgacaaacccgagcgacatgtcattgctcctttattataaagggccgatccagatatacaaaacaatcaatttgaagctattttcacaaaaaatgcagcggcatttttcaggatgactccttttctccatgccagctgcattgtttcatatcgatttttccgtttgttttaaagacgatcccttctgctagcagccgctgctttcgttctacggcggtaaagcccacgatctcgccgtctgctcgtactacccgatgggctggtaatgactctgggcaatatttcatggcgcgtcctacagctcgtgcaccattcaagcgacctaaagcccaagctatttggctgtaagaagccactttgccatacggaatcttctttacgaaacgatacacctcttcataaaatggattcatacctatcaagcagctcctttcaatcgttagcgaatttgcttgttcgctcaatgtacgataacttgcatgccataaagggcatgttcataaaaccattttgcatctgcaacagtcaaacggatacacccatgagaattggctttttgtcctagttcttctgcttcttcttcaatgtaatctcccgaagcgtcaatcggcaccgaatgaaacaagtagacgccatgatctttccaagatacccaatagttcgctccctcgccagaagattcattaaaaaaagtttctcctctttcagcttgaatggaataagttcctgtaggcgttcttcggtctcctcctgatccggtagagcaaaccatcgtataaagcactcgattcttccgcatgatcttcacccgctggtttgccaatgagacatcgacccaatctccttcttgtaaaacaggataggctttcttctcagatggatgacgccaatctgcgacggctacttctgtcgaagaagaatcctctgaggatttagacgttcctgatctctcctttttagtaattgcattttttttcgtagggatcgttgcttttttaggaatggtctgtttggtctgttctgtagactggttcttctgaccagcggctacgttatgtgataggctggcactaacgatgaataacagcacagcactcacaaacataccaatggttcttttagggtatctttctttcattatttctatccttactaagccgtcgaaaaatctctcaggcacaatttccagttcattttaccaaagctgcttctaaaacgtgattttaatcagcagtgacaaaacaagttaacagcagatttcgtttcagcgtctcttaaaaaactcttgataaaatgatccattagcagtttaacgcctttgtaactaaaaagccagttaaaaatgaaagagtagaaccagcctacaacatcgtgcagcgcttcaaacggatgcggacaggcctcattcaatcgggtggtaactaaaccctcgtcctaaaacttcagctacattgctggcaattacaaatgcctgcggatcaatgctttcaatcaattgtttgatatcagcaaattcttgatcgttgacaacgatcaataaaacttgtttctcacttcttcgatgaacaccttgtgcttctaacaaggttgcccctctagaaattgccgttgcaatggccgcttgaatctcgtcaagatattcctcactcatgatcatcacagacttcttgcggtccatcccggtttcgatataattcatcacgatcgaagtaatcacaatcgaaagaatcgcaaacaaaaattcttcaaacccaaaaaccagtaaactcattgttaccacaaccgcatctgtggctaaaagcccgatggaaggattgatatggaaatatttctggaagatcagcggcggaatcgtagttccgccactagaagaattatttttatataaaatagcaaccccagcagcaaaaatcgcactcccaaaaataacagacagcagacgatcactggccaacatatattcaggcactacggcaattgctaacggaaaaactatgctgccgaacagcaccttgaagaaaggcgctttccccaaaaaaacataggccagaaccaacatcacactgttcagaaccatgatcacaagcgcacggtcccagcccaaagcagattccatcaagattccaatgccactgacccctccagctgcaatatgatgaggacctaaaaacatgttgatgctcaccgctagaatcaccagtgcagagagtattttactataagttatcaattgcttcattgtcttcctcttttctttgatcatccgaatagaagctgtcatttttccgagaacttgtgcttttactataccctcatctctgagttgagacaaaatttctgttcagaagactgaaactttttttcttataggatcaagtacaggtaagaaaaatttgctcaaaacttggttgttcaggaaccttttgacttgcgttctgacgttcattttctcacagaatcgttggaaaagagaagcatttttttcagccttctctgaaaatgatcatccagaatgctgctgcatttccatctttttgcacttgactctctttagagattcccttattatcaaggttaacgattttaaatcagaattttctgaatttttaggcgagataaacaaaatgaggaaggatgaaccatttgaagacaaacaaacaaaccacttggtctggcgaacccaacgaagcagcaatccaactgctccagcaagaaggcaaagtcatcgtttgccccactaaagtaggctatattattgccgtctctgacaagaaaggactagaacgcaagttttctgccaaaaatcgcaaacgtaataagccaggagttgtattatgcagctcattggaacaattacaagaattagcggaatggaacgatgaaattgcggcagtttaccaaaaatgttgggacaacgatgttctttttggcgcgatcttaccatggaaagagtctggaaaagcatatattcctgacggatcgcaagaattgatgatggataccagggaaacgagttgtttcgtcatcaaattcggcgttcctggagaacaaatcgctaaagctctttgggaggaaaagcaacagctattgtttgccagctcagcaaatccttctggtaaaggcaatcgtggtctggtggaaggaattggtgaacaaatcgctaacgaagcagacctcatcattgaaagcaatgactatgtcgcttcgatccaaccagataaaacgatagagacccgctacgaacaaggagtcatggtttctttcgtagattctgctggcaaattgattcctcatcaaggctctcagcgatcgatcaccccggcgcctgtattgattcggaagggtttagctgtagataaaatccaactgtttttgtccgatcacttcaattcctgggactatcgccacggcgaatactactaagcaattcatagattaggacatcagtccaagcattcaactaaccttagctacgactcttcgaccgtagctgagactttagatcgaactgcttacagctgatgtcctaattttttgagggtaattcttgcatacaacagcattttcctttcaatacaactcttcacagatcaaatcatttctttgatcgtcatgatagcgttccagatttaatgattcagcttactggttacatcagtcagtcccctgaaaacagcctcttcctaaagaatagagctactatttcttgatgatcatctgaatcgcttgttccagcttctgtgcttgttcttgaggatctttttctggattctcgaaacaatctttcaagttctctgcaacaatcatgcccatcacacgatcgatacttgaacgtaccgcacttaactgagtgatgatatcgatacattccttctcttcttcgatcattttttgaaccccacgaatctgcccttcggcacgttttaaacgattcagcacatttttttgatcacttcttgtcttatccatcgtctcactcctttcccattagaatataccctacaatggtataacggtcaaacattctattcgtatccgcaatgttaatcaaatcaaatcattgacaaatatagaaaaacggggtttaatataccccataccgtatataaaggagaatgtctatgttttcattgtttcgttctgtcccttccatctctattcgtgatttttccgcagcactaactgcaaaaacgaaagttattgatgtccggacgccctctgaataccggggtgggcatattcgaaatgccgccaatgtcccattaaataaaatcgcccactattcaggaaaaaaagaaccgttatatgtgatctgtcaatcaggcgtccgcagcaaacaagctgccaaattattgattaaaatgggctatgatgccacaacgattcgcggtggcatgaatcaatggcaaggaccaattcaaggaggaaaataaaatgaaagtactgattgtcggtggggtcgccggaggcatgtctgctgcaactcgattacgccgcttaatggaagatgctgaaatcattgttctagagaaaggtccttatgtgtcctttgcgaactgcggccttccttactttatcgcaggtgaaattactactcgcgatcaattactactgcaaacaccagagtccttaaaggcacgttttggtttggatgttcgtccaaatcaagaagtactggctattcacccagaacaaaagactgtgactatccatcgagattctgagacttatgaagaatcatatgacaagttgattcttgctccgggagcaaaagcaatcataccaaaaatcccaggattagaccgtgccacaaactgccgtcagttacgaaacgtgccggatatggatgctattttgcagaaaatcgatcaacatacccgccaagccgtcgtagtcggtgccggctttattggattggaaatggcagaaagtctgaaaaaccgtggcttagaggtaaccgtcgttgagaaagcatcgcaggttttaccttcgatggatgaagaaatggctgcctatgtcaaaaatgaattgatagcgaagggaatcaaggtcattacgggccaatccgcagtttcttttgaagaagaagggaaaaaaattcggttagaagatgacactgtactggactcagacctgacattattgtctatcggggtccaaccagaatcaagattagcagcggaagctgggatcactactggtattcgaggaggaatccttgtagacgaaaactaccaaacgtcgcaaaaagacatttacgctgtcggagatgctatcgtcacgaaacaacaactaactggagaagatgcgttgatttctttagcctcaccagctaaccgtcaaggccggcaagtcgcagacgtgatcgctggtctgccgaggaaaaaccgtggcaatattggaactgctatcctgcgagtctttgggcttacagcagccatgaccggattaagcgagaaagcagcagtatctgcgggcttgcagccagctgtgattcatgtcagcggaaaagatcatgctggctattaccctgatgctaaagatctgctattgaaattgatttttaataaagagacaggtactctctatggtgctcaggccgttggacagagtggcgtcgataaacgaatggatgtattagccacagccatcaaaagtggattgacggtggcagatttagcagaactggaactgagttatgcaccgccttttggttccgccaaagatccagtgaacctgatcggctatgcggcattgaatctaatcgaagggatcagtgagtcaatccagtggcatgaactttctgcagaattagctgccggcaaacaattactagatgtccgcaatacagcggaaatgactggccgcttcaaaaacgccctgcatattccgctgaatgaattacgagaccgactgactgaacttgatccgactgcttcttatatcgtcagctgtcatagcggactgcgaagctatttagccgaacggattctcaaacaatctggctacgaggcaaaaaatctagacggggcttttgcgctttatcaaaccgtcagaccggaggaaatcattcatgtatcgctcgatcacaatgcctgaattttatcaagcaagcaaacaacagaagttccacctgattgatgtcagagaagtcgatgaatttatcagcggccatgtaccaaatgcgcaaaataatccgttatctcacttcactactgccaatttggagaaagaccttgactactacgtgatttgtcactcaggtgctcggtcagagcaagcctgtcactatatggaccagcaagggttcaaggcgatcaatgtattaggcggcacttctgcttggccaggtgaactcgtttaaaacacgttacaccaaataaaacccaatgaccgctactttgatccaagtagcagtcattgggttttggtttaaactcgtcagctaactattcaaaaacaaattgattgtggtaaagttcggcataaaacccgttttctgccaataattcttgatggcttccttcttcgatgacttgcccctcccgcaagacaacgattcgatcggcattcaaaatcgtctttagacgatgggcgatgacaaaactggtccgccctttgatggcttcatccattgcttgctgaatctttgcttccgtcaccgtatcaacattactggtagcttcatccaaaatcaataaagatggattggtcaaaatcgtgcgagcgatactcatcaactgcttttgcccggtactgaatagattgttttcttccgtgattggtgtatcatacccttgttctaacgtcatgataaattcatggatgttggcctgttttgctgctgcaataatcgcttcctcactggcatccggcttaccaaaagcaatattttcccgaatcgtcccagaaaacagtaccgaatcttgcaacacgatccccacatgctcccgcaatgcatctaaatctaactgtcgaatgtcctgaccatcaaatgttactgagccattcgtcacatcatagaagcgattcaaaagattcatgatggttgtctttccagaaccagttggtcctaccaatgccaccatttcaccctttttgacatggatggtgacatctttaaggattaaacgatcactatcataaccgaaatcaacatgattcaatgccacttcttgcttgataccagtgattttttcaccatttgccggtttttcttcatccggttcatcaaacatctcattcaaacgacgggcgccagtgattgccaattgaatcatgctgtaaccagaagaaatctgcatcaacggttgatagtattgttgagaatattgaacgaaagtcaccacaaggcctagagcaactgaacgttccaaatccccattcaatgctaaccaaccgccaaagaaaatcacgatcgccgtgttgaccagcgacattccttgcatcattgggaaaagcaatcctgagtatacttgtcctttgtaagtggcttcccgaacactttggttgtgctgcaaaaatccatcaatcgtttcttcttgaagaccgttggtgatgatgatccgttggccgctgattttttcatcaatgtacccgtttagttttcctacttcatcttgctgcagatcgacatatttgcgagctttttggatcacaatgactgcaatcaggatggcaattggtgtagacgcaatcgtcgcccaagctaatgtgacattttgtcggaacatcatgatcaaaatcccgatcatcaataccacattggtcaatacttgcagcaatgcttgattcaagctgttttgaatgttatccaaatcgctggtaaaacgactcaaaatttcaccatcttgatgagaatcaaaaaatttgatcgtcaatttttccaatttattgaataacccgattcgcatccgattggtggatttccccaccacttgcgtgaacaagatactataaataaagtttgctccacttgccaatacgtaaaacagcagtaacttccagatgacagatacgaattttgacttgtcatctacgccttgcatcaatccaccaacataattcgctaattcctgaaaggcttgccccacatagaccggtgcttggacttgcagataagtggctgcaatcacggtaatgaaaatgaaaaagaaagagagtttgtatcgttttaaatagtgataaaaaaacttgcttgctttgatcaaatccgtcatggttattcagctcctttctgagtctcaaaaatttcctgataaattggattgttggcagctaactcttgatgggtacctactccaaccagacgacctttatccaacaccaggatgcggtccgcattcacaacagaagcaattttctgtgcaatgatgatcgtggtggtagcttgcagttctttttcaaaggcttcacgaaccagtttttccgaacgagcatccaatgcactcgtactatcatctagaatcaagatttttggttccccgatgacacctcgtgaaatagacagccgttgcttttgaccaccagaaaaattactgcttcgttccgctacgggtgcttcaaaacggttcgtcaatttttgaatgaattcacttgcctgcgcgatttctgttgcatgggtcatttcagggacagtggcgttctttttgccgtggcgcagattttgggcaatggttccggagaaaagaatcgctttttgtagaacaaaggaaacggtttgacgtaagctttgctcatttacttctcgtaaatcgacgcctccaactcgcacggttccttctgttggatcaaacaagcgcggaatcaattgagctaatgtcgatttccctgcaccagttgccccgacaatcccaatcatttctccaggagcgattgaaaaactgatgtctgtcaaagcatttttctcatccccaggataacggaaagaaacgtgctcgaatgccacactgcctgctaattcttgctgtggaacatctttgtaggacaagtctggttcggtaaccagaatttctttcaatcgtttgagagagaccgctgcccgagaagtcatcatcatcatcataccgccgataatgatcgccatcatgatctgcatcaaataattcatgaaagaagcgattcccccgatcaatgtcggatcgtcttttgcaaggtcgctgacaaagaagatcgcgcctacgaccgctaagttggctgccagcataaaggacggaatcatcacagagaaaagcgtaccaacgatgatgttgtgttttgttagttcgtcgctgactttcgtgaaactgttcaattgatttttttcttgaacaaatgatttcaccacacgaatccctaaaagattttcttttgctgcactattgattttgtcgatcaaattttgaatgatcatgaaatgtttgcccatctgtgtaaaagaaagaccagtaatgatcactactgcaacgatcaatgcgacgattacccaccaaagttgaggcatcgtggtcatggctaagataaaggcaccaataaataagaaaggaatccgaaacaacgactgcaaggagatcatcactaaattttggatttgggtgatgtcattggtcagtcgaaccaccagatttcctgctgagaatttctcgatattaccaaacgagaaagtttggattttacgaaaggcttcttcacgaatatccgcactgactccttgcgctactttggcagagaaaatagtattgatgaccccagccaccagcccaaacacggctagaccgatcaattggaccccaatcgatttcatttcattgtcgtcttctttaatgattgcttccaatacttgttgcagcagcttcggctgccataacgtagccagtaccatgacagctacagaaaccagcgcaatgaagacagcgcctttgtatttctttacatggcgtaaaacaagatccatcttaaaacacactcctttacagtttgacaggcattatttaacactgtaaaataaagccggacaataatttaccatttttagaaaaatgttgcaagcgaacaaaggatgatttttttatggaacaaaagttatcaaaagaatcaattattcatgcggcttttgcctacctaaaggaaacatctgacctttctcagttaaccatgcgcaaattggcaaaagtactttctgttcaagcaccggcattgtattggtatttcacgaataaacaagagctgttgcaagcgatggctgaaacgatggaaaatgatctgccggatgtccctgcgggtagctggcaagaacagttgcaaacctttatggccaattactacgatctctatctccaatatccctgtggtgcagaactagagattcatacgattccttcctatcctagccgactgctgcatttagagcaaatgatcactatattgatcgaagccggcttcactcctgcccaaagccgtcaaaccgttcaggcattgcatcatctcttattgggacacttactcgatcgtcaaaaagaagaacaattacgagcaaaaattgtaactggcgatgaaaaattgcgggcacatgtctctgctatgcgcagctatgttgttgagaatcatttaaatgggatggcagaaggcatccaacaacgcaaacaaatcgacgaacgtcaagtttttctggagagtatcgcgatttatctggctggcttaaacaagcgaaatacctctctaaaataaaaaaacgccaacaaatctcactaagtttccttaaatcgctttccgatttcaaggcacgaggctcgttggtgtttttgttgcgttttttaaagcgttgttagttcttctttttgttttttcgtcaatttctgataaaccagttcataagaggtcaaaatcaactgttcaatttgttcgtctgttacctcatccgctgctagacgaatagaattccagtgggttttattggcatagtatccgggaataatcgcctcagggtattgttcacgtaattcttcattgacttccggtttatttttcaacgtaatgatcgcatcatcattcgcttcaggactcatcataccaaactgtttgccgattagaccaaaataaatcgtcccccaatcctcacgataggccacattagcacctgccaatgactgaccgtaacttttcaggcgatcgattcgttgttggatctgattattcattgccatccctccggtttgaaactgattttttctttagtgtaccatatcttagagggtttctttcataagcaaactgttgatttagataaaaaaacagacccgctaagcgagtctgtgatacgtatgaatgtttggcttgattaataccaaccgttagcttcccagaatgcttttgctgcagaccatgaaccataacgtgaagcaacataattatcggctactttttcttgattggccgctgaatagtccccattcaagtaagagttagtcaactgataacgtccatagtattggccatttgttgctgtataagaaccgccagattctttgttcgcgatccattctttagctgaagcttctgagcctgttgctgcagaactgcttgatgcagatgagcttgggtttgtttgttggctgctggcaggttgtgaagctggttcttcataagtgactgatgattctgcagctgctgaagaacgttcatttgtatagctggcatcgtctgttggtaagaccagtgtttcaccaacatagatcaagtttttgttcgtaatgccgtttgcttcaacaattttatcaacggcttctgaggtgccaaaatagttataggcaatcgtagatagtgtatccccagattgcaccgtgtattcttcatcagcaaacgcatcttgtccacctagaaacacacccagacctgcaaggacagctgtactaagcaaaacagttttcaatgacttcataaaataattctcctcatcttgtagcgtttatagtctgtcgcaggagaaatctccaacgcatagactagtctaacaccagagaatatttcataggtgaaaatctcgttacagatgattacgaatgcgtcgagttccttacgtttcgtaagcgtcgcgtaattccttttgaatcaacaacgattatcaacataaaaatataaattagttattttatttcaataaaagtgaatcccctcttttttatttgtgaattgttacaaattggatgaatttacacacagtcgtaacaaaaaaagctgcagctgaacagcgcgtttccatgaatgcttgttgcatcgattggaagcaggcgttcacttgctgcagcatctttcgctgacactttatcaaaccgtttttttcactggaatcaacttattcatcacaatagcagcaatcgcacttaacgcaatcggtgaatccaataagtattgtagaaattgcggagtttcttgtttgatctcagccggcatgaacaaaagaccgatcgctaagattagcggaacaccaataatatagagttcacgttcagaaaactcttcattcttgatcactcgaaagccgctaagcaaaatgatcacacagacaactgcgaagacaccaccgattaccgctgaaggtacggcatggatcaacgctgataacttgccgacaaatgacaagaggatgaaccagcaggaagccatcacaaagacttttttactggcaaccccagtaatggaaatgataccggcatttgttgaataccccgtcactggtgtcgttcctactaaagcagccaccaggcaaccgattccttcaccaatgacacctttattgatttgttcatctgtcacagcttcctcagtgacagagctgacggcataccaagttcctgttgtttctgctagtaataccatataaatcaccagcatcgtcaaaatagctgaaacatcaaaatgaagaccataattgacgaaaataagttttggcaaactgaaaaatgaagcatccgcaacagactggaagcctacgccgcccatgaaccaagcaatcagcgtcccgatcattaaggcaataatcaccgagctaatccggaaatatttacctaaacgagggaagtaatcacctaacatcgagaataaaatcaaaattgctgctgtcactgcagccaaaaacatgttctgattagccgataatgtctcagtagctggataaatgttgctggtaaaagctgtaggtaacaatgtcagtccaacgatcatgataatcgtgccactgacgatcgtgggaataaagttgcggacaatatacttatagatccctgtcatccctaaaagaataacagccaatgccccgacaatactagctcctaagacagtatccataccttgcgctccaaaatagataccaatgattgcgcctactggtacaaaggacggcccttgacagacgggcaatttcaagaaaaagagaacttggatcagcgaagcaatcccagcacctaaaaaggtggattggatcagcccggctgcatccgacgagctcatggcaacagcagttgcaataataaagggtgggacatacacatccattgccaacacgtgttgtaagccaagaacaatggcttgtcctaaaggtatatcttcattcattccgatcgttaaacgattacttctggtttccacagtatcaatctcctcatttttcatgtactttttttccttgcacccagacctgacgaatgttttcagccgttgctagatacaaaatcttttgtaattgttctttcggttggttcagtacaccaaaagctggcaatggattaccagaataacaagtatcgatcacttgaaggtcgcaagcgtagccttccttgataagaccaatcggtagtcgtagcgcttcgccccctccttttgtcgccaatgaaaaagcgtcgatgactgagatacgcgcattcgcaacacctcgattcgtttggggcaatgtaacatccacaccgtcttctaacatgcgggaagacataacagcttgcttgatattgtcatacaaacttggagaaaagccgccggagatatctgtgcctagtccaatcgttacgccttgttctttaagccgattgatagggatcacaccattggcaaagtacgcattggaaatcgggcagtgagcaacagcagtccctgtttccacaaagatctcaccatctttttcatcgataaaattacaatgagccatcacagctttttctcccagtaagccaaaatcccgcaagacttctgtgtcggttttaccaaatcgttccaagacgtgatcgtgttcccattggccttcactgcaatgggattgtacatggacatcgtatttttgtgcgagttgtcctaacccagccagaccttcatccgtgcagcttgggacgaatcgtggtgtcactactggatagactccttgacgtgtcgtttttgccaacttttggacttctttaatgaaggtttcggtctctgctagtgccgtagcagttgaggcatctcgataaaaatctgggttcgcgtcgggatcatccatgactactttccccactagccctcgttgacccttctcagcacaaatcttggctaattgtaaacttgcttccaaatgaacggtcgcaaaataaagaaccgtcgttgttcctcgagccagtagttgcgcaactaaatcttggtacacttctgaagcaaaacttgagtccgcgtattttgcttccaacgggaaggtacactcatctagccatacattcaacggctcatccaatgcaactcctgcttgcggccattggggtgcatgaacgtgcaagtcgacgaatcccggtaaaaaatactgtcccttctgcaattcaactagcattccttgtttggcagctgccagcatttctggatagtctgattgttctgttgtgaccacccttttgatcatcccttcagcatccacgcaaatgaggacatcctctaagtattccagcacgccatctgtgggtgtatgaaatacagaacctttaaaatattttgttattgacataagttttctcctttaacaaactgcatcagactgctgctttgacattagcagttttcattaaaataagcatcaatggttttattttacattcattcggatttttttcaataaaaaccgtacattaatcctgacaaaaagaatctaatgttcgtttttaaggcaaaaaaagacatttggtgtgttcaccaaatgtctttccttcacttaaagctgaattgtcgtaccactattgccagctaaagtttccgccgctttttccaatgaagcgatcactgcttgacgcccatccttggaagcagcaaatgcgatcgctgcttccacttttggcaacatactaccaggtgcaaattgatttcggtcaatgtacgtttgcatttcagcgacagtggctgttgtcaatcctcgttgatctggttgaccatagttgacaaagacttggtcaacagcggttaagataataaagatatccgcatcgatcagtgccgccatcttggctgcagcaaagtctttgtcaatcaccgcgtcaactcctttatagcgagtgccttcataaaccactggtatgccgcctccgccacatgcaatcaccacttgacctgcatctactaatgtttttagactgattttttcataaatgtccactggtttaggagaaggaacgacccgacgccaacctcggcctgcatcttctatataagtgtcgccgctttcagtcattaattgctgagccttagcttcactatagtagccaccgattggtttcgttggattcgtaaaagctggatcagctggatcgaccaccacttgcgtcaacatggaaacgaccggaatattttccaacccgcgagaaacaagctcttcatcaatcgcttgttgcaaatggtaaccgatgtacccttgactcatagctgtgcattcaggaaatggcatgacgtcttcttgcgttttgctggtttcctcaaatgctaagcgaattttgccaacttgaggaccattcccgtgagcaatcaccacgtgatggccgtcactgattagatcagcaatcgattttgctgccacttgggctttggtcaattgttcgtgcgcagagtcgcctaaagcatttccgcctaaagcgatgacaattttcgacatacgtctcctcctatctttgcggttgttgttgcgtgatacagtgaatattcccgccaccgtatacgatctcaactgtatttacgcccacaacttctttatctgggaaaatctctgctatttcttcaagtgcccgcgcatcattttcgtctccgtattgaggaacgatcacaccgttgtttgtaattagaaagttcatataagaagcaatacaaatgtcgccatcttctcgcggcatggttccttctacgtaatcaatcttgaaatccccattgatcgtgacattttctactgggcagcaaagcttatgaacttttaatttgcggcctttggcatcggtcatttcattcaaacgcttgtatgcagcttgagccgcttcataaaatgggctgtttttatcttcagtatagatacaagccacttctccaggacgtacaaaacatgccacgtcatccacatgtccattggtttcttccggatcgatcccgtcagctaaccaaaggaccttctcacagttcaagtagtcgcataatttttgttcgatttctgcttttgtcatatgggggttccggccattactcaacaaacacatctccgtcgttaacacagtgccttccccatcgacatggaaggatcccccttctaaaataaacccttccgtccgataagaatccacttgctcgatctcacagatcttttgagcaactaaatcatcttgatcccaaggaaaatacaagccatcgactaatccgccccaagcattaaatccccagtcattgcctcgtaattcgcctttgtcgttgatgacaaagctaggaccacagtcacgaatccatgcatcgttattggacatttcatagacagtgatgtctgcaggcaattgacgacggcagttttgatattgttgttgcgacacgaccacattcattggcgtgaatttgctgatcgcttttgcgacttcagcaaatgcttcttgagctggtttgcccccatcacgccagttatccgggcgctctggccaaatcatccatactttctcttgtggttcaaactctccgggcattctaaacccgtcttgtttcggtgtggtcttttcgattcgtttcgccatgatacagcactccttcttttttgatttttttgatccagataatggcttcaccaacgagggcaaatacaattgctccaatcgtgattggtaattgctgactcagtgattcagcgtcaaattgcaaaggaagcgctgtgaaaatcaatgagatcacgatcatgatcatcggtagtgcgactaataccttcaagaacaaatcgctgccgctcaccttgaaaggtcgaggtgtgtctggatcaattttacgtaatttataaaacgcaggaaacacagggacatacgatagtaggaacattactaggttcagtgagaaaaatgcccagaataaatcttgatttggtaaaattggggcgatgacgacgacgatagaagcaacgataccattcataattgccgcaccagtaggcatgccattttttttgctgcgtttggcaaatactttcggcatatcgccattttcggccgcatagcaagcagtattattgacccctaacgaccaagaaatcatgttgccaaacaatgtcagcaagaacaaaaaggccatcgaaataatgaaccagccgcctgttgatcctgtcaataatttaaaactatccatcaatccactgccggtactgatttgatccgtaggaatcgctacaccgatcccgaaagcagaaaaaatgtaaatggcggcaatcaccagtccaccggcaatgatcgattgaggaatttgcttcttagggttttccatgtcacttgcaaatgtacaaatcacttcgaatcctaataagttaaaaatgattaccgagataaaagacaaactattcaaattgaagcttggcaccatcgaagaaagagtgaactcattcgcaacacctttggtaagggccgtatagagacctaagccaccaatcaagattgctaacagcatcttgatcactgctgccccattcaaaatccacacactgtcactgaccggataaaaactgatccaaacgatgacccatataaaaatcagttcgatcacgatagcagccaccgtggaaaattcacgacctgtgatagtcgtcaacaagtcaggacagactacggctagagaggctaaccataatggataattgatccagtagtaccaagaaacccgagaaccccagcgatgaccgaaagcttgtgtcacccaatcataaataccgccatcaccaatatacgttgttcctaattctgatgagattaacccatagggcaaaaggaacgcaaccaatagaaagatccaccaaaaaaactgtgaatttccgattgctgctaccggtgcagccgcttctgccacaaatacaacacaaataaccgataagatagcactcatcaaactaaattttttcttttctcccattgttttcttcctttccggtacaagggaataagggttgaccaacgattgaaggattcttgcaactagcggatttctctctcgtgaatcccagttcagcacataagctgcgacattattagaacgagcttccgctcaaaagaatcgattcgcagttcgttggcccctcctcaagaaccaaaacagtcttcacgcatccccttgatacgcagactatttcctttcctcatctcttgcgtctagtttcatctaacaaaacttccaagtctttttcagccgctgcttttttggtctcgtcgattggatttttatccgcataatctcgcatcaagtacactaagagaccgcgaatcgacgttaaccggttttctgcttcatcaaaacagatcgagtttggtccatccatgacctcatccgtgacttcttctccacgagtggcaggtaagcagtgcataaatttcgcttgttcaccagcgcgtttcatcaagtcagcgttcacttggtatttagggtaaaaaatacgcatgcgttcctcttctgataattctgcttcatacagtccataccaaacatctgtataaacaaaatccgaaccttcgatcacatcgatttgatctgatatcgtataggaaccgccagaatctttacaaatcgcgtctaatcgtgcgcgatggtcttcgtttaactggaacccttctggaccaaattgaacgaattccatccccatttttgttgcaatcaatcctaaagagaaacagacttgtgtggcatcaccaataaaggaaatcttgcagtcttcgatttttttgcctgctggaagatgttcgatcatggtgcaaagatcgccaagttcctgcgttggatggttgaagtcagacataccattaataactgggatcgtcgcattcgttgctaagtcatacacactatgatgccgttccacgcgagccatcaaaatgtcaactaaacgagaaagaacacggcttgtgtcttctattgtttcatgaccacccaattgaatttgtcctggtgcgagatattctgcatgtcctcctaattgtgtcattgctgtttcaaaagaaacccgagttctggtagatgattgttggaaaatcatccctaatactttgttctttagtaaaggggggtaataaccatttttgatggccgctttgattttcaatgacaggtcaacgatttgttggatctcctccttcgtgtaattttccgttgtaataaaatctcttttttccataatgaaacctcctaagtgatttgtttgcttttgcatcttcactttaggtaaaaaaggcggagtttacgataagctattagttgtaaacgttatcacacttattctatacttgctgaggacaagtttatttttggatataaaccagttattttccaagggtttacaaaagtttagaggaaagtttagcggaattaaaagtaaagaaaaaacaaatggtgttataattaggataagaaaattggtgtaagaaaaattgaaaggggattcaatatgatagctatttttatatacaatattttattgatcattctatattcaatcacgatgacttttgctatttattcttacttaaaagaaaaaaacaaattatttctttggattagtttgtatctggcattctttatttttgacaatacaattatttatatgacggaatttctcaattcctttgcccaaagttatgatcaagcatttatgagtgcaccagcagttaaaactattatatttatgggaaatgcctttttctccatttctattcttgccgaactacacaaagaaaaaacctctcccctccattatacgctattgatcgttttggccatttggatgattacgaccccactgatggaaaactcagcatttaaagtttggctctattatctgggtaatcaactcttccttttttatctaggaatttattgttggcaagggaccaaaaagaagctccctctactgaacaaacgctatttaaaacagttgatgatcatcaatctcttctttagtattttgatcataattgaagatagcttcgtgattttcaatgtcgaccagtacagctcgttagcgacaaagatttataatcgcagtatttcagaggatatcttttcgattgttgtttgtatattattactgcacttctttatcaaagaacgccaaccacaggaagaaaaaccgcaagagcaagacgcctctctcttgattcaaaacttttgccgtattcatcagtttacccaacgagaaacggaaatctttgcgttgctgttgtcccatcaaaccaatcaggaaatcgccgatcagctctttctttcattgggaacggtcaaaacccatgttcataacatttttatcaaacttgagataaaaaaacgcacgcaaattatgattctttttgaaaagtacaaagagacccatgaggcagctgcctaaaaaagacctggaaggatcgcttccaggccttttaaagtttaaaaaccagtcattcattgctctgaacggcttattcttccatatatgcatacttgatgatcgttgacggtccgaaagttggatagtacacacctttcagggaaggattgaccataatactacgagctctttggtagattgggacaatcccggcggtttcttctactaatagtttttctgctttgatcatcgtatcccaacgtgtcgctaaatcattggcataggtcgtattgctatcagcaatcaactggtcatagtctttattttcataattcgtgttattcggtgaaacgagattgtaaaggtacgtcatcgggtcttgataatctggtccccatgttccgatagctaactcgtaatcgctttttcgtgtcaattcaatcgaattattcaatgggacagacttgatttcaacggtcaagcccggtaagactgtctgtaactgatcctggatgaattcagccacttttttatctgcatcagtgtctttggttaacatctcgatggagatcttatccccaatatcagcagtggctttttgccagtaagcgagtgcagtggctttatccggtccttcgagaggcgcatcttctcgaaaatctttgccagtttccggattgaagacaaagttattcggaataaacccattgattgcttctgatccatctgataagacatctttgactaaagcttctttatcaatcgcataataaacggcttttcgtacattttcattggcaaagatcgtatctttaccatctcttttctgattcatcttgaaatagtggatataagaggtcagcaccgtctgtagttcttcgttagcggcattttgcttcacgtattccccataaatatccgccatatccaactgtccttcgttgaaaagattatatcctgtaacagcttctttgatcacttcataatggatattctccagtttgatggcatcacgattgtagtagtcttcatttttttccaaatcccatgtagaggaagcttgatcccaatttttcatcaaaaaggggccattagttaaaatattttcacttgatgtgccataagcatcccctttttcggtgacaaaagcttcattttgtggaaaaaatggagtaaaggccaatatcgaagtcaaataaggaactggctgttccaattggatctcgatcgtgtactcgtccgtagctttcgcacctagttcagaagggtctttttccccattgatgatttcggtgccatttttaaatgtaccgtccaataaaaacatgtagtttgcttgattggctggcgtggctagccgttgccaagcataaataaaatctttagccgtcactggctccccattactccaagtagcatcttctctcaacgtgatcgtgtaagtcagaccatcgtcggatatgttggggaaatctttggcgatagccggtgcgaccttattggtgtcatcgatttgatacaatccatcaaagacattgacttgggcattgatacttgccgtatcttgtgtagagagtgtatccattgatccgatttcgctttgttccatcaaattgaccacactgctcgcttgggcagtcgctttggattctttctgataactacaacctgaaaaaccgatgacgctagcaacaaccaacaaaaacatcattcttttttttcctttattcctcatttacgtcctccttttttacatgcgtcccaaccgcttatcgaagcgctttttctaaaatcgtcatctcaatcaattcagcttgccaatccagctcatcatatcggtagcctttcttggcagactcaaattctccccgctgattgtcgatggggtctgctcgtaagaattgcttcgctacggtaaatcccccttgaatacagttattagcaggtaagcgaaaaatatctaggtttccaaaataataaagccagcgctcttcatttccgcctcgaaatgcgctgcccccaaacgaaacatctacataaagccaaccgtactctggtagatagaagcgcgcccagtcatgagggcccacaaaaaattctgaaacatataaacccgactcccattcagctgggatattcgccatacgacacaaagtgataaataaaagtgcttgaaccccgcagtctcctttctgattgactgcgcagtactcactgatattcggaatcgcataatattctcgcataaatgaataggtcactttggtggtcacaaaatgataaatcgcatacgcacgttccaagggattttttgcttccggcaaaatttcctgcaataattgctgtagaaaaggcgtaaattgaatatggggagcgaattcattgagcgctgatgcaaatgcgtttttttccgactcagtcaactcacgaatcatggtttgctcatccaacaactggaataaatccgtataaacagccgtcaattcatagctgtgttccacagtcgcttcaattgaggaagggtcgttggtttcaaatgcgatcgttcgctgtggtgcagcgaagggatcaatctgcttgaccgctccttttgtctgaagaatcttggcatttgctacctttccagtgtctcgaggcaaaggaatgtgcgtcaagaaaggaccgtcttctttattaagcgttgttagtggtctaagtgattgtttcaaaacgattcgagcagtcctttgtccgagttgtttcattttttctacattctcatccagttctacttgtctggcactgtcaattccgttttcttcctcaaataaatagcgcgtataatagtctgagcgcgtcttaacgagattagcaataaagcgttcatggaaaacttttttgccgttcaagtagatccattcaacctctcctgcttccactaagcgatccagttcttctcgctgaaaatcgacaaaggactgttgcatcatctccagagctttcgtttcttcatagggatattgctttgcttcaaaaacagtcaaaacctttaattccgtttgcaaacgatcttttaagacttcactgatacgggcattgttcagcttctgatgaatgagtctacgtgttaaagaaaaatcaccaaaatctttggctcgttgaatgtcttctggcaaaggaaccactagattggatagatcattaggatccatactcactgcgccacctcctctttttgtttaacgcctaatccagccgcttcattaagttgaatcaccggtgttttttctgtaccaacaaccccttcatacgcaagaactgctaaatcaaacgtcgcgtcaaggtcagcgaaacgaacatttttttgtgcagcaacaaagtgagctgccgctgcgatactaatattggtctcccctgccatacaacctaccatacaagggatattcgcagcttcgcaaatactattgatctgtaacgctggatagatgccgccacatttcatcaatttgatattgacagcatctactgcatcttttttgatcaatgataacgcatcttggggtacaaatgccgcttcatctgccatgatctgttggttgacttgagttctgataaaggctaatccatcaatgtcactagcaggtgttggttgctcaaaaaaagcgatgtcatatttctgcaactgttcaatcatttttattgcctgctttgctcgccaaccttggttggcatcaattctcaattcgatggctggaccgacagctgcccgaatttgttttactcgttcaatatcgtctttctcatccaatccgactttgatcttcagtgcagtaaatccttgttccacaaacaattgagcattctctgccatcacttctggagtatcgatggaaatcgtcatatctgtctctacttggttatcctgaccgcctaacaactggtacaaaggcagtcctgtactttttcccaatagatcatagcaagccatatcgagagctgctttggcagacccattgcctttcaggcactggttcatgatgctatggatccggcttaattgccgtggatcttctccagttaatgcatcagccaataactttagagcagcttcacagccttcaagtgtctcccctgtcactaagggttcaggtgttgcctcaccgatcccaaagtcccctgtgtcagtgatcactttaatggtcaaattgctgacctcagtaataacgcctaatgcaattttaaatggcttgcgcagcatcattttatttgcagcaatttccacacgttcaattttcatcttcattcccccctctaacttaaaactgactatatcattccgtttttttcttttcaacactttttctgaattttctgaattttatttttatacagattatgcataactctaccaacttatctcctttgagcagtaaatttaataacaaaaaaagagcaaaaatttgctcttttaatcagataattgtattttattaataatcgtcggatgccaacgaacattgatttgtttgattgtatcaagcggacactttggttgtcgatcagctgttaacaaaccgtttttttcctgttccacatccgtcaactgcgtataacaaaagccgtgaagaatttctgactgatagacagcatcaatcacccgctgatagtcctgaataaactctgcttcattagctgcattggtatatccccagccttgagcccctgtatcatagccgatcccgccaaattctgttaacaagataggaacatcttgatgttgaaatcctggacaataaatttttctgcgattgggttcagaagttaaaatcgtatcttttgttcgcaaactcgccgcaaaatggtcgtatttctccagttcttctttcgttccatgaacatagctgtgaatcccacaaatatcactttctgtcatctcccagccatcatttgagataaccaatcgagtaggatctaaagaatggatcaagtgataaatcgcctgcgaaaaatgctgttgctgacgatcgacactaatgttcggtaccccccagctttcattgatcggtacccaagttgtgatacaaggatgattgtagtcacggtcgatgatctcttgccattcagccatcactttccccccgctagttcgtgtataaacactcggtgaggcacattctccccaaacaatgaatcctaactgatctgcccaaaacaaaaaacgggggtcctctactttttgatgtttgcgacagccgttgaagcccattgctttggctaattcgatatctttcttgtaatcttcatctgtaggagctgtcatgagacttgtgggccagtagccctgatccaacactagtttctgataatacgggcggttatttaagtggaccatgccatcttgaatatgaatttttcgcatgccaaaatagcttttaacggtatcgatacactttccttgtgaccaaacatcaaagacgacatcaaagagattcggggtctctggagtccaagtccatccgcgaccgtgaaagtcactgcggtcgatcttttgattgaatagactgtaagagcgtgtgaactggtgctcggtcaactgctggcgatcagaaacgatcagctcttcgccgtaataaattctggtacacaattctttatccgtcaaatcaccagcataatgataggcgatctctacggatccccgatcaaactcactggtataaaagaccttttctaaatagccgtttttgtcaactgcctccaaccacaccgtctgccagatacccgttgttcgggtataccagatagcagcagaatgttcctgccaatattgcttgcctcttggtatttcttcatctgttgatggatcaaagacctttagtgtgagcagatctttgtcaaaggtcaaatagtgagtcacatcaaaagaaaatgaggtgtgtccgccaatgtgttcccctactaactgatggttgatgtagacccagcaatggtaatcgacagcgccgaaatgtaacaataaacgtttgtcttgccaagtatctggcaccatcagctctcgctgataccaaacaccgtcatgaaagcttttgatttcaattccactttgcttggactgaaagacataaggaacttcgatcatctgtgtcaatgcttgtggctgttgttcctctaagttgtcggtaaaatcaaattgccacttaccgtttaaattcagccatttccttcgttcaaattgtgggcgcggatattctggtctgttcatagtcgtcctttccttttcaattttttttattacgaggcaaactagcctttgcttccagaagtaagactgattccttgaatgaaatacttttgaccgaagaaaaacaagactaacgcaggaatcgtcattaatgtagaagccgccatcatgatattccattgagaagaaaattgcccttttagttgcaataatccgagagctaatgtttgtttgctaggatcattcaagtaaatcaaggggccaaaaaaatcattccaagtattcataaacgtaaaaaatcctacaaccatcatggcaggtttaactaacggaagcatgatcttataaaaaatctgccagtgggttgcaccatccaggatcgccgcttcatctaattcttttgggataccagcaaaaaattgtcgcatcaaaaagacattgaacccaccaccgccaaaaaaggctggggcgatcaaaggtacaaaggaatttacaaatcctaatttattccacatcataaatgtcggaatcaacgtcactgcacctggaagcatcattgtcgcaatgaccatcgcaaaccacatattcttgtatttaaagttcaagcggccaaatgcgtaaccgcataagcaagaagtaaagacattcccgataatgcagggaataataatcaaaaacgtgttaacgagataggtctttagatccaaaacttgaaagacatctgcgtagttagaaaataataattgatcaggcagccacttaggggggaactcaaaaatttcataggaatccataaacgagctgcgtactagccataaaaatggaaccaatgagatcagtccaatcaccactaatggaacatacatcatgtattttgcttttctcatggtcatttttcttgccctccataatacacccaattttttgccgtaccaaaaaccagcatcgtaaacaaaccaataatcacaaataggatccatgctaatgcggatgcataaccaaactgattttcttggaatgctttccggtagatcaacaatgcgtaaaacaaggtcgcattattggggccgcctccagtcataatgtatgcttgcgagaatgtctggaaagacccaatcaaccccatcaccaagttaaagaaaatgatgggagagatggctggcaatgtcacatacaaaaatttatggcgccaattgccgccatctacttccacagcctccattaggtcttggggaacatcctgcagcccagctaagaaaaccagagcggtaccgccacatccccatacggccattaaaatcaaagatgggatcgctgtttgttcatcaaaaatccagttagacggcggcaaatggaaaaattgcaaaacagaattcagcaagccaaaatccgggttgaataaccacatccataaaatgtttgaagccaccgctggaactaccaccggcaagtagaacaatgttcgaaaaaatgcctgtcctcgaactttgacattcatcaacaatgcgatcactagtgcagcgatcaaactacttagcgtactgccaaaagcaaaggtgaatgtcacaaccaccgattttttgaaaaaaagatcatccataaaaatcgtacggtagttatcgatgccggtaaatttgaaatcaccgatgacattataatctgtaaaactaagaatcagactaacgatcattgggatgatggtaaaaatcaataatccgagaattgcaggggctgcaaaagcataccctgcacgattctcttctttgtgtaaatcatattgtttctttttagattgttcatctgttttaagtgtgatcattccttcgtccacctacttcacatactcgtatttgtccccgaactgtttctctagttttggcaaaatgtcttcctcaactacttctcttggagctttcttgccagtccagacctgttctaacgcggggttcacgatttgctcgatcgaagcagcatcttcactgtagaaggccttgttttttgtcaacgcttgctctttcgcttcaaccagtgcttcttttttatattctggtgaacgatcgcttacggcccatttttgaaggtacgtttcatctgagaaccaattgtcttggttaggtaaccataatcctgaatcgatgacatctaaactattctcagggtctaaaagatactctaaaaatgttttggtttcttcccaatgttcttgtgtgttttcattatcaaaaaccacgattggcggaccaaaattcatttgaacgacttttcccatttttggtaaaacacccatacctaacgctaaccctttttgttcgatagcgtcccccagggaacgtaagtcccaagatcctgtgatcgtcatcgctactctatctgtcagcattgcggtatcagttgaaggaatcgtacttgcctgtgagggtttcggcatcacataatctttgtacatcaaatcctgaattttctctaacgcttcaatcgaagcatctgttccaatcaggatttttttgccgtcctgactaagcaccccaccgccattgctgattaagaaagattcatagcctagaccagtaaaattggagatcccataggttttgatatttttttcgtcaaaaccagcatcgcctggatgattgccatttcggtcgactgtcagttctttcagaatggatacaaatttatcccaatcccacgcttgattgacgtcatgaggtggaacttcaacccccttttcttcaaaatatttcgtactgtagaacagtgtaagcattcctggccctgcaggcgatccaaagactttcccgttgtactccgagcgtgtctctgcgattttgttctcaaatggtcctcctgattcatacagctctgtcagatcccttaagttgccgctcttcccccactctgccgtgcttgtttcaaccatatagccgacatctggaagtgttttggtactagcttgtgtgtttagcttctccatataattgtcataagggatctgctgcgcttttacttggatctcgtcttgtgattcattaaagtttttgattaatttatcgatcgaagctttctccaatgtatcgccccaaaaagaaaaattgagggtaactttactcgcttgatcaccagcatcattattgctcccacatcccgataataaaaaacttccgcctataaccaatgaggaaatgagtagaccaatttttttcatcttctttgctcctgcctttttatattccatttgtatgcgcatacaatagttcaaaaagaaaatcagacggattattttttacaaaatgattgcttcatgttgccaaaataatgctgtctgtttttctttacaatttatactatacaaaacgaaaatacatatttcttcccgagttatgtgttccttattcccgatttttgtttggctctattttctaaattagaaatcgattacatttattctatcaggcacatcacacagtaaaataaagagagcaacaccgcatcactatctatagaacaaaggagtagaatacatgagcttatacttggaaattcctgaaatcaatccgctgttccctttcaaaacctttacaaatgaagggtggtcgatcacttatcctcactggcacaaagaaattgaatttatttattgtttggaaggaactgtcagattaggggtggatgacgagatcattcaaatgcatgtagacgagatctattttttttctagtggtgaaccgcacttcttcttgtcttcgccaaatagtgaacgaatcgtttatcaatttgatatcaaactctttcaagggcatgacaatatctcgccaaatgatcgtccattggccaaagtatttgagaccgtcgtcaattacagtaaagattggcctaccccgatccaaaaagagatccagactatcttgctttctatttatcatgaaaaccagaaacagcgtgaagggtatcaatacagtattttgagcagtttgtataaattagcgaatctcttgtaccaactgccattgaagaacaaaaaaacagaaaaagccgctttagatagtacattaaaaaatcgcgagacattgttccagatcgacaccatcctcgactatattgagtccaattatttacatgcgatcacgattcaggatgttgctgatcatgtggggtttagtcctagttatttctcacgcttcttcaaaaaaaatatcgggatgtcttttaccagttatctggcagaataccgcatccatcgggcaaagtatattttaggaacagagctggttcccatggcagaagtagctgcccgctcaggtttttctagcgtcaaaacctttcatcacgtctttaaatcaatggttggcacttctcctatgaaatttcaaaaaaatattttcggctttcactaaataactacgcaagaaacctatatagtcaccaaatcggcgaattctgcatttataacattttgtccaaattaggcaacgcccaaccataaaaaagagatctggaagcatcagatctcttttttattcactctaaattgaagtcctcaaaaaaagaatcaattggtttttttaccaattgattcttgcgaatgatccagcaaacagttgctcacggcttacaacctcagagcggttgctgacatctgctcattatagaatgttgtcatgctctatttacagaccttctttcagatgttctttgctagtttttctcacccagatgtctttaccagtttgttcaataaataattcagtttcaggagctagctgacactcaactttaccttcctttaaagtaattcgcaattcttccccttgataaaaaagcttaaaggcaagttctgttatttcttttggtaggtgattggacaagcgaatgccttcatcataataaagaccagcaaaaccataaatcaaacttagccagctgcctcccatatttgccccatggatgccatcgacgacgtttttttgcagatcagtcaaatccatcaatgccgtatccatgaaatagcgatatgcttttgctgtttctccgatacgactagccatcacactgaaaatcgaacgagacagcgaagaatcatgggtggtgactttttcataatactgataatcttgttttagttgttctagggtaaaatcacccgtaaaaagcatttgcgctaatacggtatccgcttgtttgcagacttgatgtttgtaaattatcatcggatgataatgcaacaataaaggatagttagcagctggtgtctcttcaaaaggccagacagattgttcaagaaactcatcatcttgcttggtaagtccacgagacgcatcataaccgaaatacatgaggtctgcggcttgctgccattgatcgatcagttccatatgcttttcgtatcgtttcgccagttcaatggcataatataaattgttttgagccattttgttggtataaaagttattgttgaccaatgcactgtattcatcaggtccggtgaccccattgatacaaaaagaaggtttgccgtctttttcgatgaaatcaccataactcaaccaaaattttgccgtttcgaaaacgacttcactgccgacttcttcaataaagcggacatctcctgtgacccgttcatagagttgaaaagcataaacgatatcggcattgatatgcagttgtgcggttccggcaggataataggcactcgtttcttgaccatcaatggtgcgccatgcaaacagtgcaccgtcttggctcagctcttgtgcccgtttttgcgcttgcggtaaaatagttgctcgataagtaagcaatgctttcgcagtgtctggattggtgtaagtaaaaaaaggcaacaaatacatttcagtatcccaaaaataatgaccttcatacccttcacctgtcaaccccttggcagcaaaattggttctgccatcacgtcctgccccctgattcaggtgaaacagattgaagcggatccccttttgtagttcttgatcacccgtgatttcgatatcactcgctgcccaaaactgctgatagctttccctctgttcggcaacaaatgtttcaaaatcaaccgcttcttgataaaagggtgcgccctctgcttcttgtaatcgcagttgaaaaatcgtcgtcagggattctccagattggatttgcccatcgccgcctatcacccgaatcgccagttttttttgactatgaggggctgtccaaatggcatagtcgccatgctcttctttcagaagctgatgctctttattcgcaacacgaggatcatctgtttgattgactgtgaagcgctggtccaatggatgggaaacagtgattggctctgtgaaatttgcatttttgattgtgtaacgacaaacataaaattcactgcgcgtcatggaggcaaaagattgcatctcaagatcaaagcttttgcctaatggggtttctacatggtaagactcatgaaggatgccttctgccatatctaatgtcagctggatttgttccgtctgccaaacgctgtccgacgactgctcttgtccgatgcttaaagaaagcccccgcaggttgggtaacttgcagatggtttggtgttctttagcatagccataagcccattcgccgtattggatcggttcactgtcaaaaaaaccattgacaaaagccccgggattcccaggatagttcgcattcactttaaggggatgccctgctcggacaccgatttgaccattccccacagcgaacagcgtttctaaatattccggtttctgatgagagagttcttgtgcctgcaataaaaatcgtttgtccatctctgttcgtctcctccgcttttttctttcagttctatcctacactactaaacacccattgcaaagaatccgacttcagctgggaggggcatctactttggttcttctgacagagtatggtaccatgaaacaaacttgaaagaaggcgattacttggatttatggctaacaaatattcgaatggaaacaagctacatcaaagaaaatggctggtcctctggcagccaaaccaaacgggcggcgattgggatcagtgaagaaaaaattaccgagatccttcccatggatgaatggaaagacacgccaggaataactgttatcgatggtcaaggccagttattgttacccggcttgattgaaaaacactgccatttggataaaagcaaattaggaactccatggcgtcctgtcacaccggcagccaacttagtagaacgttttgaaacagagattcctcaattggatgcattgcctctttcgattaaagaacgggcacaacaattgatcgatttggaattgcctcatggtgtcgtgtcctttcgctcccatattgatattgaaccaatgactgaactgcgctattttgatgcactaactgaattgcttgctgacaaaccatttggtacggaacttgttttgttcccgcaacacggtctgctgcgatcaaatgccgtcgcattaatcgaagaagcattagctactggtaaagctgcattcattggtggggtcgatccttatacattagatcaagattatcagcaatcattaaaaacaacctttgagctggcaaaaaaaggcaatgttggcatagacattcatctacatgaccgcaaagaagccggtcgtgcaacgatcaaagaaatcattcggctgaccaaagaatatgctatggcaggcaatgtcttcatcagccatgcctttggcttaaatgattttgaaggagctgaacgcacagaagtttttcaagctttagcagatcaggacattcatatcgtttcaagtattccaatcagtcagggaacgattcctccccttaaagaattacaaagttatggggttgctgttcacattggttgtgacaatatttatgattcttggtcatcactgggtgacggctccttgcaagaaaagctcgctcgttatttagagatttttggcgttcaatcacaagaggcattgacccaggcattaggcttggtaacagatggcagagtgccattagatcaagaaggaaatcaacaatggccaaaagttggcgattctgctgattttcttttgacccctgtttcttcaacggctgaatttgtcgcccgcaaaggtcacgtcagctgcagtttctttaaaggacaaccaatctacaacgcataaccaataattattgacaaaaaatgattcggtcacctctcttttgctgatttcgcttgacgctgatccgattattcggtttacttatgatagcgaatacaaaaagtgagggattaccatgtatactgcaaatatgcaacgatatgaacgcatgacatataaccgtgtcggaaaatcaggtttaaatcttcctgcaatttcccttggtctatggcacaacttcggtgatacagatccaattgcgaaacagcgggaaacgatcttaggagcctttgatctaggcattacccattttgatttggccaacaactatggtccccctgcaggatcggcagaaaagaatttcggccgcattttaaaagaagacttacaggcttatcgggatgaattgattatttcatcaaaggctggttactatatgtggcctggtccctatggtgaatggggttctaagaagaatttgattgccagctgtgatcaaagcctgcaacgtctaggcctagattatgtcgatattttttaccatcatcgcccagatccagacacaccattggcagaaacggctcatgcactggacttggtagtacggcaaggaaaagccctctatgttggtgtatccaattattctgcagaacaaacaaaagaaatcgccaagattttgaaggatcaaggaaccccctttatcatccatcaacctcgctacaatatgtttgatcgttggatcgaagatggattaacagctgtcttagaagaggaaggattaggtgcgatcgtctttagccctctggcacaaggattattgactgatcgttatctgcatggtattcccgaagactctcgagcgcatcgctcagatagtccttttttaacagaagatcgtgtagctccaaccttaaatgtagtcagacaattgaatgatattgctcaagagcgaggacaaagtttggcagaaatggcattagcttggctgttgcgtcaagagactgttgctagcgtattgattggtgcttctcgtttgagtcaactacaagcaaatgtccgggctttggaccaattaactttttctgctgaagaactaaaaaagatcgacgaaattttagtgcttttaaagaaataagcgtttgatttgctcgctggcctttcccatgggggaactgccccgcattgagtaaaatggcggaaacttcatttcaaacaacaaagaaatcaaacgaccgcagtgtgtattgtccagaagctattaatgcttcgatgcaataaccctcgcggtcgtttggttcttttttgctacattttagttgattgattctttttgccaatcaatggctaattgcaggcagcctttgatgccactttcattcactagttgccatggaacaatgtactcttctacacttggaatcgaaatgtagccccctagttccagcaaaaattgttctctgatttttgacagcaagtgggtctgattcatgacaccaccgcctaaaataatcttatctggtacaaaggacaatgtataattgaccaatgcttgcgctatataataggcttgcagctcccatacaggatgattttcaagaagagtctctcccttttgccccgttcgtgcttcgatggaaggaccggcagccagcccttcaaagcaatcctgatgataagggcaagtgccgacatatgaatcctctgggtgccgtttgatccggatatgccccatttcaggataagatttgccttggaataactggttattcacgattacgccggcaccgatcccagtccccaccgtcagataaatacaggtatcgcagtcttgagcagcccctttttttaattccccataggctgctgcattgacatctgttgtccaaaccattggaatcggatagcgttgttttaacgtccccaaaaagtcaaaattttgccatcccgctttaggtgttgccaaaacatgcccatagttggcttgcttggggtccaatccgattggaccaaagctgccgatccccatcgcggccagctcatacctatcaaaaaatcggaaaatttcggccagtgtttctgcgggttctctcgtagcgattcgctgtgaagcaataatcttcccctcttgatccgctactgaacagttcatttttgttccgcctgcttctatgcctccatacatcattgcctatccctacttttctactcgaatatcgaaataatccattactagctcacaaaacatcatgtttgcccaagaaaaccattcacgagtgtaatccgttggatcattgacattgataccctcatgcatcaaatgcgttcctgcatcgatcgctaccaactgatctaaaatttgggctttttcttctttgtttggtgtcgtcaatccagtcatcgccatcgcgatcggccaaacaaaattatgcggtgtatgagatgagccgatcccactagcaaattcgccttgatagtaataaggattttcgtcacttaaaagtgtttttctcgtagctagataagttggatcttccatggagccatagcctagataaggtgcagaaatcaggttaggtacattgctgtcgtccatgacagaggcattgcctaacccatccacttcataggcatagatcgtttcgccagcttgattcgtcgtatacgcatatttttcgatccccgcttggatctcttgctttaaatcggctgcttcggccactaattcaggcacatctaaaatgtcggagaaaatcagttccaaataacctaatatcacaacagcgaacatgtttgacggaatcaaatagccatagacacaagcgtcgtcgcttggacgaaatcctgaccaagtcatcccagttttagcaactggggttcctttgccggcgaacttcagcgtatcttcttgacgttctgtttggcgctcaaattgatatggtgactgcgcgtgatcttgttctgtccgaaagacggttaggacttttttgaccccttcaataaagtttttatcaaagtgatcggtgcgccaggtgtttttataaagtagataggctaactggatcggatagcacaatgaatcgatctcatatttccgttcccagatccagccgttcatttcggttagatcatcttggtgtccggcaaaattttctgtttcattgaaggcattggcgtaaggatcgatagtgataaacataaattgctttttgactaatccggcaatcatatcagacagttcttgatcatcttttgctaaacacaggtacggacggacttgagcggttgaatctcgcagccacattgcaggaatatcacctgtcaaaacaaaggtactgccatcttcttgcttcttgacagtggttaatacggtattggcaaatgccgcattaaagttttccgcccaattttcatggtcttcgccacaaagcaacgtgattttctccataaaactcttaattactttcggtatttcgctgtatcccatcttcttttccccttttacaaagaagagccgacaaaagtagacaaagccgctggtctttctgcaacgagaagcttcgggtagttgatgttcaagactgttcaatcctccatcctatgcccgatttgctaagaatgaaccaaccttcgctgatcttgaaaatctgctgccagtcctttcgctttgtctactgatatttctcttcaaactttaaatgattgcagcactttctaatgccatgacccctgataattggtcagacaagaaaacactagttggaatttctgcgactaaccagtctcggtaagctaacagatgtccttccttctgactatgctctaacaagcgttcacagctggatgtcacaaatcctttgatggaggctatgtctaagcccactttttctgcttctttgactaagagattcaaataacggtattcaatgcctttgaacaatccaatgtcaccaccatctccttcatcattgaagaccccatctttaccaataacttcaaaggatgttttggcacaagtgattgcatcttttaaataagaaatatcgtcagtcacatgataaaattctatcaatgctccaatatagaccccttggttgtaagtaaatttccattgcacatcgattttgccatcgccattacgattgataccatcttctacgaattgtgtgtccggctgtaccaaatattttttcatccattctagtgtctgttggcttgtagtcagatagcgttcattggcttcaacttgatacagacgtaatgctagaataataattggtgcatttacaggtgtattcttatagtcaagctgcgtgcgtttccaagcaaatccgccattcatatgatcattccaagcagtatcaaaaatatccagacatacttctcgggcgtcagctaggtattcttttttcttagtcaagtcatacaaacgtaatccagctaatgcgttccacaacatgtcatcataaaattcatgcagcaatgtgttatggtttcttgctttattgtaatgataggtttcttctgcttgctgcaagtaagccatatcgttggtccgcagataagcatcaatgcgtacatccactaaatgcgcgatccaccagtaattgaaggtttcattttctttctcatcccgcaatggataaacgttgttcataaattgttctttggaagctgcttgatagaaataatcgatacttgtttgtgcaagatcggcatacttgttaaaatcggtcattctcctgatccttctttcaatattttgtcaccttgttgttgagcattttctagtgctttttgcggcgttgtttttccagaaaagacattttctaattgtggaataagggctagtttttcgacatcggaataccccataacagttggtcgaattttagcaaaatccatggtttccacaaaagctttgtacttctcattttcagtaaagtaggtattttgcgctgcttcgatatttgctggtagccaagtggaaatttttgcaaactcgacaccgatatctgggttggtcgtccaccatttaataaagtcccaagctgcttcttggtttttggccgttttgggaatcactaaaccaaagccacccgtcaacgcccctttgtccccatttggtccagttactggagggacgaccccataatccaagccattcactttatcataatctgctaatgcccaaggtccgttataggtcatcgcaactttaccagctgcaaatgcatcagatccatcattaaatccttgttgatagaccttcgcttgattcattaattgatcccagaaatcaagaacggtcattcctgcctcagaattaaaagcagtggcagtattatcagcgttcagcatggttccgccagcttgctgcaaccacatattgaacaatccaacgtcatcaagagaaaaaccagcttgcactaacgtttttccatcccattttgttgttttcttcgcaacatccaacaactcatcccaagtctttggtggttctactccagcttctttcagtaatgttttgttataaaagagagagcggttgtctactaaaagtgggattccatattgtttattgtcgtattgcatttctttgacagtttcttcataaaaatcgcccatatctacattgtcttttttgatcaaatcatctagatccaataaggcattttttttggcatacatcgctgtattgacgcgatcccacaagataacatctggaatttcgccacccgccattccggtcagcagcttttcttcaacgttgtcttgaactttgtaggtcacctcgtatttgtcttggctatcattgtattgatcgatcaattgattgagctgatcgacttggtcaccactccaagaaccccaaaaagtgattttctgctttccgccagctccatcattgcttgcctgatcattgcctccaccacatgcacctaacactgtcatcgctgctactaacagcaatcctttgattatgtttttcatcacattcactccttcgttttatttgataccggcatctgccatgccttgtacataatttcgttgtgcaaaaatgaatagaactaaaacaggtagtgttgccaaaatcgttcctgccatcaatggaccataatttgtattgtagttgtattggaaagctgccagtccaacttggaccgttttcatttcatctgcattcaagacaatcatcggccacataaaggcattccagcctgcttgaaaagtcataatacctagcgttgtcaaagcaggttttgctagcggaaaataaacattccagaaaatcttgaactcacttgcaccatcgattcgagcactttctccgagttcttttggtaattgttcgaagaattgtttcataaagaaaatcgagaacgctcctgctgctccgggaagcaggattgcccaataggaattgatcaatcctaacccaccagtaccagttagatcattccctccagccaacgggaatccgcgaagcacaataaaggttggaatcattgtgacaatacttggaaccatcattgaagctagaaaaacgagaaagattggtttcttccctttgaatttcagctgaccaaaagaataaccagctaatgaaccaaaaaataaatttgtcgctacacccccaagtgctaatatcaatgaattttttaaatagtttaagaaaggcatcgtttcaaaaacttctttataatgatcccaagtaaagtggcttggaatgatttgcatcgatccgctgagaatctcgctatcggatttaaaggatgtcgacaaggtccagataaacggcagaaccgttgtcaaactgatcagaatcaccaagcaataccagatgaatgactgcatatgttttgttttagccatcgttttttctcctttagtttgtttctgtattggtcaaacgcatattcaccagtgaaaaaatgaaaatgatcatgaacaagataaatgacagcgcagaagcataccccatttctagtccaccaaatcctttattataaatatagtaaacaagggtgattgtggaatttccaggtccgccttttgtcagcatataggcttggtcaaatacttggaaagcgccgatgatcaattgtgtgctaactaagaatgttgttttggataattggggccaagtgatactcttaaatttttgccacgcatttgcgccttcaatatctgctgcttcataaagagcaggattgatcccttgtaaacccgccaagaaaatcatcatgtttccgccaaaactcatccagacactcataatgacgattgcagtcattgcccaattggaactatacagccaagctggaccattgattccaatcaaactaagcaactgattgagcaaaccatactgtggatttaagagccaataccaaatggttgctgtagccaccgatgaacataagactggcaaataaaaaaatgttcggaaaagactggtggtcttcattttgcgattcagcaacatggcggctgctagagagacgactaatcccaatggcacatacagtaaggtgtagacgatagtgttctttaatgaaataaagaaaaattcatcttgaaagatacgcgtgaaattctttaaaccgatccaattggggctttcaatgatcgtataatcggtaaaactatagaaaagtgccatcactatcgggataattgcaaaaacaactagtagaagaacaggaaccagaataaatacataggcaatgttttgctgttcattgatccctctctttttctttcctaactccatttattaacccccttattaaatataatataaaactatttaatatattaaatatctttacaagcgaattatatagaattaaaaagaatatgtcaacggtttcataaaaagtttttttgattaaactgcttgctttattaatataatatatttaatatatacataaatagttcttttattttttgagaaatggaggcgcatgcatgagtaaacctttgtaccaaacgatttatgaagatttgaaacatcaaatcgaaacaggcactgtcgcaatcaatgacacactgcctactgaaaaagaattatcaactacctatagtgttagtacgatcacggtcaaaaaagcactggatctgttaaaagaggatggctacattgtcagaaagcctcgaaaaggttctgtcgttgtcacaaataagaaggcagacattgttccgaacaaactcattttcggattgatcatcaccaactttacagacttttttggcgctcaaatactgcgaacagttctagaaacaaatactgaagaaatcaatttcatcgtcaagatcagttatggtgatcctgatcgcgaaaatgagttgatccaagaattgattgaaatgggcattcagggtttgatcctactgccgacatcatcagaatatacctcgccaaaaatcttagaattgatttctaaaaatttcccgatcgttgtaattgatcgtctgatggcaaatttgccgatctgcagtgtgcaaacggatagctttgctgctgcaaaagaattgacaaattatctctttgccaaacaccatgacaagattggcttgattacttccgatagcagtgtttcaacgattgatgaacgagtcaatggttttctctctgcgcatgtggatgccaaccgggctgtcagccaaaagcagatcttgtcgaggatcgactctgtggtccccagttcttctcgcaagatcgaagatgatgtggcacttatcgtggcctttcttcaaaagaacccagagatcacagctctttttaccacagaatacaatattgctttacttgccaagagtgcgattgaacaattgggaaggcaagtcccacatgacttttcagttgtttgctttgaccatcctaccgtcaacatttttgacttgaatgcttttattttcactcatatcgagcaagaccaaacagccatcggcaagcatgccattgatcttttactgacaaaaattgctcatcctgatacgattgaaaagatcaacctcggctatcggttgattgaaggagattccgttatttctagatgatcgtctgttcctctatcgaagcagtacattagcgatccgactacaaatagacaaaaaaacacacctccgttctgactcgctgaacgagtcagaacggaggtgtgtttattgggatagctgtcattctttaaactagacagtcctccttttagttattctcgatgactgcgacttcttttcttgtaggcatccccgtttgggcacctaatttttgaacagaaagtcctgcaccaagattcgctaaaacgaccgcttctttaaatggcaccccatcacttaatgcagccgctaagataccattgaaggtatctcctgcaccggtagtatcaacgacggtcactttctttgatgccacggtcacgattttaccggaatcaacgaaacttaccccttgactgcctcgtgtcactaccaatttggtagcgtgcgtttgctgccaagctagaatcgttgcttcgatttcaggttcagggatcaattctttaccgatcaatgcggcaaattccgtctcatttggcgttaagatatcgacataaggcagtaattcccctacgatatcatgataaggtgcgggattcagtagtgttgtcacgccattttcctttgcgagctgtaacgcataccgaagcgtatctaccggaatctcaatttgtaccagcaaaacatcgctttctatgattttatcagctatttgatctacatattcacgatctatcagtccattggcaccggagattacagtgatgcaattatcttgcggtaatttaaaaatacttgcgataccagtaaagatatttttttcttgtgcaactgactgaacatccagttgctcttcacttaagtgtcgatagactttttccccaaacgtatcttgaccaatttttcctaagaatgtcgttgttccgccaaaacgggcggctgcaactgcttggttggcccctttcccgccgacaaaataatcaatttgatctcctatgatcgtttcgccaatttttggcattcgcccagtcgtgataacaatatccatattcacactgcccaaaactgctattttacccactaaatcacctatttcttttgtatatatagaacgggccaaacgcttcgcgacccgtaacagaagttgtctctatcaaagaaaaaccggttttctcaaataagtgctgcatcggctcattcgtatggttggtcagagaataaatggcatcccctgctttacaaaagtctcttagacaagttttcacccaagccgagcccaacccattccccatttctgatgcttttgtcacgagcctttggatacattttgtatgttcattatacccatgactctcttcgtgcgccaaaaattctggactaagggttcctgcactaacgatttctcctgattcatttttatgaatcagtaattgttttttacagatatctgttttgacgatatccttatcagggtaactgcttgtccattggcagatcccctgtgtctccatatttttttttgcatcaacaaacaactgccaaatttcatccagttcttcattgcatgcatatattaacttatccatcaaatcaataaggcagtaacaacagcgacaagacaactactaggataattcctatgatcgtaggaacactggtccgtttcagcaaacgaaccggactcacaccaatcgatgacgaaacgatcatgacaactgctgcaactggtgaaatcgtccgcgctaagttagcaatcatttgcattggcagcgcaatcaagataccatcgataccggctttttgggcaatattgggaatcagctcgatcacagcatagaacatggctaatccaccaccactcaaaataccaaataacgctgtcgcgccactgaaaatcagtgtggttagaacaccggcagattgagagttttcaaccgcactcatcaaagaatcgatcacgcctagactttgaatcgctgtggtgaataaggaacccccgactactaacataacgacttggctgaaaccttgtcccattcctttgaacagttcgactgcactttcttgggcaatcttaaatgatttcttacggaacccttcaatgatcaatgctacgaagaatgagatcattgtcaaaacaaaaatgtccatcgtcacattttctctaaaaataccaataattccaacgataatgatcaagactaaaggtaataatggcaaaatggcataaaatgtcgggacaactttttcatccgccgcactttcaacttctttcatctcgacaaacgcttctgaaccttcctttttatcgcaatacgtttgccagaagtagtggacaacagctaaaataagtaaggttgggatcgagaccttcgcatgatacagcacataagtcagaatgttgtaatccaacgtttgtgcagcaatcacattgtctgctcctaatggtgttggcatgatcgttgcggtcattgcaatgacccctgctgctgtcattgatgaaattccaataccttgtaagagcggatacaaaatagccattaaaataattgctaaactagaggcacttggaacaactagagacatcaaatttcctaacaggaaaacaatcggtataaacaacgctttggatttgattttggtcattggcttgactaagatattgaccgctttttgattggcaccaatcaaattcatatagccggaatagccaaataaaatcatgatcactaatcctgctgagctaacttgtgagatgatcgtgtctttcagtttcagaaaaatatcaaagaaagccagaccagttccttctccttcaggatagagaggatttcccaatgccaccgacgcacctaataagacaatcgcaccgataatcaaaataagcgctggattataactcttaataataaaataaccaacgatacctaaaacaactaatactaaaattgcttcaatcattttttcccctcctatttacactgactgattgcatgtaaaaaccattccttgaatttattctcatcgacatcgacacagacacggcaattcttttctttgccaagtttattgttcagatcgatgatcgtagcgccagaagtatactccccttttgtttctactgcgacaaaggtttctttgatctcaaacatttccggacaaagaacgtaagctaaagcacagctgtcgtacatttttaatccggtaccaaaacttccacctcgatatttcttgaaaaggtggtacatcatatctccagtttgattcatgtctttgattttttcgctgtcttcaggataaaccagtgctttcaacccgacatctaatggtgcgcctgctagcgaaagaccgctttcaaaaacgattttggctgcttccggatcaatcgcgatattgaactctgacaaaataccaaagtttcctctgcctagcgcaccacccattaaaaccaattcttcaattctttctttgacttcaggatgcgttttaagaagaagtgcaatattagtcagtggtccgattgcgataatcgtcatcttctctgcagaagccatcaatgtgcgatgcatggcttcaacggcactctcttccaataaacaactgcgatttggtgttggaaactcgtaccctgccattcctgttacaccatgaacatcgctggcatcttttacttcacgaagcaaaggtccagctgcgccttgggccacaggaattttcaagttccaaaaagtcagcaacttcaacatattttccgtcacatatttgatccctacgtttccagcaactgtcgtgattaatttcacgtctaactgatcactgaacaagccaattcctaatgctactgcatcgtcaattcccggatccgtatcaataattactgctttgttcataagtaaacccctttcgttttttgataaaacgttttatcaattggctaaaaataaaaaacgtttgataaaacgttttatcatttgttctcccaaagaataccacttatgtaaagcgctgtcaataacgaatacaaaaaagctttccataaatttgcgctgaattctaacctagacaatcgttgtgttgatcagttaaacagctacgtcctgatataaacacaacgattacctttttcattctatctttgattccaaccgtttgccaacgcttttttttcgtacgatttttggcgtcaattgaagataacgcggcgcttgttctttcatcgctgataataaagaagcaactgctttttcccccagaactgtcacatcttgttcgacagaagtaagtggtacttctaataaatcatttaaaatcaaattatcatagccaacgatggacatttcttctgggatattgattcctaactccttggctcttttcatgatccctaaagcaatcaaatcatttcccgccacgataccggtgattgcttgattgttcaaaagctggtctgctttgtcataggcatcttcaaactgaaattttgtgaccacccgccagctttcttgctggggcagctgcgcttctttcagagcatccagatatccttggtagcgataaatacagttgatatttttatcggggttcatcataataccaatgttttgatggccattattgatcaattccatggtcgcaagatagccgccttgtcgattattataaaacacttgtccaaccggaaaattatccaaccctcgatcaaccagcaccaatggtacagaaatactgcttaaaaactctttcaactcttcttcgtaagtataagattcactcgaaagggctagtaacagtccatccacattacgatcgatcaataattgaatcaattctttctctgccgcaaagtgatcatctgaattgactaaaatcaaaaggtaaccaatttttcgcaactggtcttccagtacttttgctaattgtgcaaagaaaggattattgatgtctggtatgaccaatccgatcgtatttgttttgtttagcactaaactttttgccgcaatattaggcgaataattattttccttcgctaattgtttgatcaagcgttttttcttttccgagatgcgaatcggtttgtcatttaagacttgtgagacagcagcgattgagacgcctacttcttcagcgatatctttcaagcggatcttcactcttcttctcctcgctttcctgttttattctacgccagtccttaaggttcgtcctttctctattctatcatagctctgtttatgtaagacattcagagtcaaacgattggctattttttctgacatgagtatttggaattcgcctacgtaaagagcgcctattgcgtttttaaaatacagcacccatgaaacataacaatgaccggacgttcttttgggtttcgagaagtccggtcctgttcttttacacgtttccttagtttaatcattctttgcgtgagtgatcttggttctaactaaatattaaatcgaacccaatcggcaaaaagctcgggccaacgaaccaccgagtcttcaatggcgtgttcgccaccactggccgtttctttggttccgagacttagaccatgcccacctctaggaaaaatgtgtaattcataaggaatgtcaaacttacgcagttgttttgcaaacaagagactgttttctgccggtaccagaccatcttccaatgtgtgccataaaaatgttggtggtgtgttgcgacttacttgcttttcaagggaaagctgcgccttttgttcgtcataacggtttcctaaaagagcacggaaagacccttcatgagcaaattcaccgcttgaaagaaccggataacttagcaacaacccatttgggcgccattcgtgattggctcctgacaatgtttctgttaaaaagtcttcttgccaaaatacgcccaaacttgctgctaaatgcccaccagccgaaaagcccgcgacaatgattttctccggatcaacgtgccactgtgaatgattttggcgaatcaattgaacgctcgcagcaagctcttgcaatgctaatgggtacacatggggtttgatactatagtggagaacaaatgcctgaaacccaaaactcatcatcttgattgctatgggttcagcctcacggtctgataaaaactcatagcctccgccaggacaaataatgattaccggtcgcaaccgatcctgctccatctcttcagagttgtcaatcacataggtagtaagcgttgcttcacttttagaaaacggttggatcacttcatggatcatagtaattgcctcatttcatgataattttgctaacaactggttctttgatttgtagatgagtatactagatttttagaccagctgtagttacttgtcaagtcaaggaacgatcgatggcgaattcctcttgtttttttcaaaggggttgccgacaatttgagaataggtatcccagatcgaaagtcctttgccccttcattccaggctccttcaatcttgtacgcggcagcaatcgccccatgaaaatcccgaggaaaaagaatcccatttgctgtaagacctgttcataatccttcccagcaatcacaataaaacgattacatatgatcgtatcatattttcaatcatacataacagatttttgtttttttcataaaaaaaactgtggcataagttgaacaaataattacccgatcagaagggtcgcctcctgacgaaaatggtcgatttgcctcaaaaagccataacttgctgacttctctggtagcaattaggtagttatctgtttcggcttatgtcacagcctatttcattaaatcaagtaatcattcaaacgagatttcacgtattcaatgtggctagattccagctccacttgatcatgtgccaatgcgtaatccgttaagctttcaagatcctcctgatctgccacgatctttgcgccgatccctacgttaaatgaggcatagcgtttttccttcaattcatctaagaaacgatcttctttgatttttgctgcggctttcaatgctcgtgcataggtatccatcccagcaatatgtgccaatagcaagtcttccatttcaaaagatgaacgacggactttggagtcaaaattgataccgcctggtgcgataccgccattttccaatacttcgtataatgccagcgttgagtcaaaaacattcgttggaaattcatcggtgtcccatcctagaagcatatctccttggttagcatctaaagatcctaatgcattatagctacgagcaacagcaatttcatgttcaaacgtgtgcccagctaaagttgcatgattggcttcaagattcaacttgaagtcgccttctaagccataatgttggataaaggccatcgtcgttgcggcatcaaagtcatattgatgtttcgacggttcttttggtttaggttctaatagaaattgcggtttgtgaccaattttttctccataagcaattgccattttaaataggcgagcaatattgtcttgttcgaatttcatatctgtgttcaacaacgtttcgtacccttcacgaccaccccaaaagacgtagttttcgccgcctagttttttagagatatctaacccttttttaacttgggcagctgcataggcatagacttctgcattgttcgttgaagctgcaccgttgttaaatcgtgggtgagaaaacatattggctgtgttccataacaatttgatgcctgtttgatccatcttttctttgatcaggtctgtgatcacatctaaattttggaagaactcctctaaagtttcaccagaaggtgctacatcaacatcatggaaacagaagaattcagcgcctagcttctcgcaaatttcaaagaatgcttctactcgatttttcgcggtttccatttccgtttcaccgaaccaagtgcgctgattgaccggtgccccgaaaggatctgaaccatcttgtgtcatagtatgccagtaggcaatcgcaaaccgtaaatggtctttcattttcttgcctaggactacttcttctgcatcataatgccgaaaagcaaacatattggccgtttctggaccttcatacttgattttatcaatcgttggaaaataattcattttggttcctccatttttagttttttaacataacaaactaacttacttctaaaataagttacatgaaacctttagtagtggcgattctttcgttgattactctgactgcaatgctgccaattcgcgacaaagaggtgctgtttgttgatacactttatgataaacagaataaatccgttgatactccgttacattttctgcgattggctggattactgacccatactttacaaaagccttcacacaagccgcttcgtcaggataaagtccgcttccgattgccgctaacatcgcggcccccatgccgggaccttgctctgtggataatgttgtgatctctgcagcaaaaatatccgcctgcatctgaagccactctttgtttttcgcacccccaccaacagaaacgattttgctaaatttccgttttgcttcttcttccatgatcagttgagagtctttcagagaaaaagtgatgccttccaagaccgctcggctgaaatgccgacgtcggtgatgggtatcgatccctatgaagcttcctctgacagtgctgtccgtataaggagttcgttcaccaacaatataaggggtgaacagcagaccatctgctccgggagaaacctccccaatatctgctagcaattcggagaagtctactccttctgcgaatgtatctcgataccaacttagtgagttaccggcagctagtgtgacacccatcgagtattgtttttttgccactgcatgattgaaaacatgtaatttcccttggtaatcaatcttctgcgcttcaaaagataagaatacaccgctagtaccgatcgataccatcccaatgccttcgtcaataatcccagatcctagcgcggcacatgcgttatcggcgccgccagcaaagattttgacttctttttcaaagccaaattctgtttgtaaatcagggaccagtgtcccgacttcagctgctgattcaaaaagtgtcggtaagatttcttctggaatagcaaacttgttgaggatttctgcagaccaacagttcttctcactgtccagtagtaatgtcccagcagcatccgaataatccattgaataggtacctgatagccacaatgctaagaaatctttcggcagcatcaagtgctggaccttctgccaattgtcaggctcatgttcttgaacccaacagattttaggtaatgtgaatccttctagtgcaatgttctttgtgattgaaagaatctctggcatctcttccatgattcgctgacattgcttcgtcgtccgaacatcgttccacaaaattgctggtcgaatgaccttgttttgttcgtctagcaagactaaactgtgcatttgtcctgaaaagctgatgccgatcaattctttgcgcaactcaggcactttatcgatcaacgctttaatgactgcatgagccgcttgacgccaatgattaggatcttgctcactgaatccaggtcggggggacgacaatggatagtctgcactagcagtgtcaatcagatttcctgattgatcaaaaaccaatcctttcaaagaactcgttcctagatccagtcctagtaaataagccatattcttctcctttgctactgatgaaattcttatttgttatggtttacaaaatattgcttttaggttaatttgcttaaaaaactaactaattggatagtaaacgacctatccatttttgtcaagcgctttcaacagttatttgagacttttttaagcacctaactgaggaatatctccttttacagataaacttgcactttattaatttgcacggtaaactaacattactatagacgaagaaggagatactatgattattaacaaaatgggcatccgagagcagaatgaagctgccgtcctgaaaaccatcattgataacgaacatatttctagagctgaagtttccaacttaacgaatcttaacaaagcctctgtttcgcaaataatgaaaaaattgattgaaaccgattttgtcaaagaagtaggaattggtgattccacatcgattggcggacgcaaacctatccagcttcagttcaatcatcaaagcagcttagcgattacgtttgatattggttataattatgtcaatggcatgctatcttatatcaatggtcaacgaatagccattttggaaaaacaagatatcttgattacaaaagacaacgtattcaccacgattgattcgataatggctgaatttacccccaagatgcctcctactacccatggattggttggtatttgtttagcgatccacggtatcgttaatcaggagaacatcacttttacgccctattatgatctggaacacattgatttggtctctcctcttagtcagaaataccataccgcagtctatatcgaaaatgaagcaaatttgactgcattaggagagtattgcttttcgtctgattcaactaatctgctcagtgtaagtattcatagcggcatcggtgtcggcatcattgtaaatggacgtttacagacaggaactcacggaacagctggagaagtgggtcattctacattgttccctcatggaaacctttgtccttgtggaaatcgcgggtgtttagagcaatacgcttctaataaagttttattcgatacctacagtcactatacaaaaaaagagcttgtcaattcagatatttttgcaaaggctattcgttctggcgagaaatcagcgcttgaactagcacaacaaaatgtcgaatttttgagtatcggcttaaataatgtcattacatttttcgatcctgaagaggtttatatcaacagctctgtctatcgcaaaatccctcaattgaccaaagacctgcaacaaaaattaaccagtcagttcactcagaatacgaaaatcaaaaacagtcgtttgggcgaacaggcacctctgttcggtggtaacgttctgattgccaagaacttcttaaacattgaagatctgcgctttccaacggttgatttcctttaatccataaaaatttttttctgatacagaaaatccactgattcatttagccaccgtataacttcaataagtggcaacacaacaaatggactgggacataagtttgggtaactgactctcgctgcgctgcaggagtactctgtgctcctgcacaatttcatacgtgttctcctgtcagatactttggttatcattctttatttttccttatatcatacagtaccagcaagacaatattgaaaccccctcatcaatcccttctcccagcggcttactcttttatgtctcctgcagtgatcccgccaacgatatatttcgactgcaatcatttactcctattcaaaatcaaaaggtctcttccccttctaaaaaaggaatagacctacaaagtcagaattgcttgaattttccccattgcttttgatcattactcatcttggttctttagttttgtcttttttagtcttgcccttattggaaggcttgattttccttctgatacaaaaagaccgaatagcgttaacgtcacgcctagtagtttcactaaactgatcctttctcctaggataagaaaagaagcaaataatgtcgtcacaggaaccaaataaatatagaggccagccataacagcacctagctgttcgacggtgtaattccatagaacgaagcacaacgcggaagcccccagtccaagaaacagcagataaagcagattgtccgtttgaagcaatttatctaacgaaagggaacttttcgtcaaaaagaacagcggcataataaatagaatgccatataggaagatcattttcgtcgtgtcgatcacggaatgtccccaactagcgatctttttgaccaacagtgaatagaccatccacatcagggcggctgctatagctaaaaagtcgccaaagggatgaaacgaaagatttcctgcaaagctgatcagaaaaataccacaaaaagaaagcaaaaaaccaataaagaatgttccctttaatttcgttcgataaatgagagcagaggctaagccaatgaagagtggagaaatggaaacaatcaccgcaacattcgatgtacttgtataacttaaagctatgttctctaaaaagaaataaaaacaaacgccagatattcctgctgccatcaaataaagatgttgacgaaagtgatagtgtatcctgctaaatttggataacacactcaacgccactagtccgatgataaatcgtaaaaataatatcgccgtgggtgaaaaatcaatcagcagcagttttgtggcaataaaagttgttgaccagaagaaaaccgtgatcaaggcagtgacatggggattcttaaataaatgattcattctgtactccttaaatacattttttgatattgttttggtgtcagcccaataaagcttttgaatacattggagaaatgactttgatcggagaaattcgtcatcaacgctacttctgataaggactgctgttttgccagtaatttctttgcttcatcgattcggatcgataacagataccgataaggtgtcatgccatagttttttgtaaattgatgaatgaaagaactttttttcaaattcgtcaacgcaacgagattctctaaacgaatgtcttctgtataatttttttgtaaatgatggcaaacattttctaacaggacattttcaacgggttcattctgatacccttctgctgtataggcaagcaagttttcaataagcaaatacatcaattcctctcgatatagaggtgatttctttgaaagaatcgcttggtacaattcttcgactagttctcctgtgctattgtttcgcaggatgacttgactaaaataaggcagatcctttttgccggtaatttcttttaccacttgtgtcattgcttgcttggaaatgttgagggcgtggtaggtgatttcttggttctccagactttggcagctatgaggctgatagggattgaataaattcagatcgcctttttcgaggatttgtgtctctccgcaatacagctttcttcttcctgctaacaaaatacccactacataataatcatgaaaatggaggggaaagctcttttgatacttttctaacgcataggcctcaatgccaactatttcatcatagtgaacctttttcatactgttcctccttttctatctattttagcattgaacctttcgatttcttgtaaaatattccatgcttttctcggaatcatcctacatttaacctttccagaccctatttatgaaccaacgaaaaagcagataaaagaaagatcgcctttcctctatctgctttaattgtttgatccgctcttctagtttggatttaccagacattttataggcgcacgctcacggaaaaatcatccctcaaagccattattgtcagagacttgcttgaaccaatatcctgatttcttgatactccgtttgcggtcattttctaaatcaacagaaataaagccatatcgatttttgtaagcattggtccatgaccagttgtccatgcaggtccacatgtggtagcctaggcaatttgccccttcttgaattgcttgatgaacatatttcaaatgctctgagacaaattcaatccgatagtcatcatgaatcatcccatcttcacctaagaaacgacgttcattttcaacccccatgccattttcggagataaagcacggcaggttgccatagttatcccgcaggttgatcaggatatcgtaaatgcctttttcatagatttcccaaccacgataaggattcatttttttgcctggcatatcatacacatcaaaataattttctggcattggctctgctgcaggatcgacaggcgtttctttcgctttgatccgccgtggctgataatagttgacccccaacaaatcgacagtattatttttgatgatgtcgagatcgctcgcttgcatctcaggtaccatgtctaattctttcacgattttcaccagttcttctgggaaaattcctttgaccgcaggatcaagaaatgaacgattgaaaaaagcatccgcgatttctgctgctcgaacatcttcgggattattactgtctcttggataacttggagttagattcagtatgatgccgatttgaccagtttgcccactttcatggtaagccttgatcgccaaagcggaagccaatgcttcattaaatccgacttgaatggcatgtttcatgttactttcttctggataatgcaattgatacaaatagcccgcctcaacaggaacgatcggttcattatgagtaaaccattttttgactttatccccaaacaagtcgaaacatgtcttggcatatctggcatatgcctccacagtctctcgctggagccagccgcctttttcttgtaatgccattggcatatcaaagtgatacagattgacaaatggttcgatcccattgttgatcaattcatcaaaataatcattataaaaagaaacagctttaggattgactgcccccgttccatcaggaatcaaacggctccattgaatcgaagtccgaaaagagttatggccggtttcaaccatcaattggacatcctctttgtagttgagatagacttccgatgctttgtctggacctacttgatcaaaaaatttttccggttctttggcataccagtaatcaaaaatattctcgcctttgccgtccccggctacccgaccttctgtctgtgggccgcttgctgcggaaccccaccaaaaattttctggaaattgaaccttcatgtttctgctcccttcggtaatcctagtaattgattttccattaagaccacttgtttttcagtggccgcttttcccattttgattcgttctaagacaagttctgcggctttctcccccattttttctgctggcggattcacagttatttgcggcaacaaactctgttctgcttcagaaagataatcatagtgaccaaaggcgatatcttttccaacgatcagtctcttttgattgaaacattccaaagcccccactgacatgttgtagttactgacaaaaattgcagtcgctccccatgcgactaattcttcagttccccgataaccgctttgtcttgtgtagtcccccaccacgattttcatttctgcttcattgtttgccatagcagcttgcgcaccaaacagtcgttctctcgcagtgtgatccgactgtggggcggaaagataaccgatttttttatgtccagctgctaaataatggttgatgacgtcaaaaacactttgacggtcgttcaataagagaacatcggcgacattggcgatatctggactgttcaaagatataatcggcacatggatatgtgttaatttcctaatatctgtacattcttcgccagataagaaaacaatcactccatcgacagcgtgtcttagcaagtattctactttttcttcattctttttcgaactattcgaaaacccactgagtaataaactatatccattgtcctcagcaaccttttcgattccagatacaacttccgaaccaaatcgactggagatgctattcattaaaagtcccaatgaaaaactgcgattattttttagaccctttgcgataatattctctttataatccaaagtatcaatggcagaagcaattttttccatattcgattgtttcagttgctggccattcaaataacgtgatacagttcctaccgaaacacctgctagttgtgcgacatctcttattgacgccattttaatctactcctactattcgagatcgatttcttttgcaagatctccaatcatgatttttacttttttaacgtaatgccactggtcatctgcacccatatatcgaaaatcatcagatgataaagtaaatacaattgttttttcctcttgaggttccagctttaccttacaaaagtctttaagcatcttagtccgttggataactgaccctccaagcaatttaataaacaaaagtgtactcactttgccagcaaaatcacctctatttcttactttaacggatacttggagtttgtcaacattccttttataagcaagtgattcataagtaaatgttgaaaagcttaatccttcgccaaactcatggagtgggcttccaggtaaatcatagtagtcctcttgtttggacgcatctcgttgataataatagacaggaagttgggagctgtttcttgggtaagtgatacctaatcttccacttggattattttctccaattaaagttttagcaattgcctgtccacctgcttgcccagggaaccagccaactaggacagcatctgagcaatcctctactagagttatatcatagggtcggccctgaataagaactgttacgattggtttatccaatactgataatttccttaacaatagctcttgttttcctcccaatgaaagagaagcaacatcaacattttccccagaatccatattaattccctttgatgagacagcaccatttttcaaaaattccatatcgaaatttcgagcactagaaccacctaaaattgtgatgataatatctgcatcttgcgctatttctattgcttgtttaatttttagatcttgatcttcttcgtttctgacttcacacccttccgcatatacaatttctgcatcaatcattgtatcttttagtgcttgcacaatggttttcttttgttggtctctcgtttgaggagcggagtagtccccaagtaaatgataaatactctcagcattgggacctatgactgcgatttttttacctttaggattcaatggtaggattccattatttctcaaaaggaccaaactctctttggctacttcttcgttcattcttcttgatgcttctattaataatttttgatcagtaggttggacaaagggattttcaaataatcctaaaagaaattttactgctaatacacgactaaccgcatgatctaaagctttttcatcaatggtatcatttaagataccagattcgattttagtataagtctcatcccacaagcttagatctacccctgcatttaaagcttgtgcagctgcttctacctgatcttcatagacatcactgagtcgatctaatgcaattccatcagccataaccagtccttgaaagccgttctctttacgcaagtgttgttctaacagtgtttgatttacatgacatggcacaccatcgatatcattataggcagccatgactcccactgcatttcgtgcactttttaaaagcggcatataaatgtctgcaaattcccttttacctataggaacggttcctgaattatgtcctcctaatgcatctccctgagcaatacaatgcttcaatgctacgccaatttgatctggacttttgttgatatctgaaacacgctgatctaggaaattaatctcatctgagatcaaacttccttgaaatcctttaatcacagcttcgctcattcgagcactcaatataggatcttcaccaaaacattcttccgatcttccccatcgtggatctttagctagatcaagtgttgagactaatgctatgtgaacaccttttgccgccaattcctgagccatcaaatgactggtctcttctatcaattgcgtattgaaagtacatccgcgaccgatattcgttggataagaaatactatctaatgcttgatgaccatgaggacattcttcaacgatcaatgcaggtattccccatcgtgaatgactaatcacgtaatcttggatttgattgaccactttccaactttcctgagcgggaattccatttttgtaatcaactttcgaccaagggtctgcacgaaataatccgtaaagtgctcctagcccgcccccccactgaacatgctctttgaaggattttgttaattccatttttcctttttgatactcataacaatcccacccgtataagtgttgattcacttgtccgactttttcactcaaacttaaacgactaataagatcggaaactcgttgtcgtatcgttaaattcggatcttgatacggatattttttatccaagttgattcactccctctcgtctcgctttgttcgctgctaggacaaatggaacaaataaaaagacatctagtacgattaaaataactgtaagaatcgctgctttaatatcaccgccggtagcaataaatgattgaatcactggtggcgtaatccacggtgcggctgctactgttttttcaatgagtcctatacttgttgcaaaataagcaataattagattgaccgatggaatcaaagcacatggaatcatataaattggattcattacaacaggcaatccaaacataataggttctgtgatattgaataagcaagtcgttaaaccgaattttgcaatttgtcgttgttcttgtcttttagagacccaaagaatagcgattaccaatggcaaaatacatccacccccaccaatcagcccaaaggcgttggtaaaaggttctgtaataatattcggaatttctttccctgcagaaaacgcatccatattttcctgaatcgactgtaataagggtgcttgcctaataggtgctaggatactagaaccgtgcattccaaatacccaaaggaaatcagagaaaaactgtaagaataagatgccgggaacagataaaacaaatgctttaagtggtgtttgaatgatcagttcaatcaaacttggaaaatctaggccagccaatcgattcagagcaaatacaaaaatcgcaaaaattaaaatcacaacagtttccggaatcaacgaattaaatgaggttgctactgctggtggcaccccatcaggcatttttattttgattcgtttgattttagctaatttcataaataactctgttcccaataaagacgcaagcatcgctgtagctaaaccagatgaagaagttaaactttgcataaatacaccagttgcttcagctgtactgccatctgtcagtgtcaccatgcttttgactggcatcaaaataaataagagcgcaacacttaaaacaccggcatgtactgcactaaaggcaggatcatccatctctccagaacgaatatagtgattcgccaagttccaaccaatattataacaaacaacaactgataaaatactcatcgtcccattatttacaatgacagctaaatcagctaatggacttaaatcaataaattgctgaactgttgcatttgaaaagatcaaggcatttaataagaccataatagaggcagccatcactaaaggcatagtgatgataaaactgtcacggatggctaacaaatggcgttgactattcatttttgaaacaattggtaatagtttttcagataatttgtctacaaaactcataggtacatctccttaagtttaaaattgaaccggttcaattttaaactatagcacgtttctgtagaattgcaatcttttttttggatgcgtattcattttctctttccactaaattccgaaaaaaaaagaaaaagatgaatggtctgcaagatgtctcaagagctagtcagcaccattcatctagattaaaccaaacaatgtcccgcttatccaagtaattgattggctagtaaaaagtctttgacttcggttaaatcagtaaaacgccgaacaccttgaaagagcgcctctttgtcgatgattggttgtttgctcaatgggtatcttccttttcttgtcggtaagtctgtcaaatcatcttcgaccataaacgctgagatgcccgctttttcagcagcagctatcccggcaaacgagtcttctaagactaaggcatcttttgggagaaccttcgcctgacaacaagccgtcaaaaaaatttccggatcgggctttccttgcttgacttgatcgccagctacgatgatatcaaaggtagacggcatcttttctagctcaaaataggtggcgattttttctcgggaagaagaggaggctaatgcgatttggcaggtgtgctgcttcagctcctttagtaaatcgagcaaacctggctttttgtagactcttttttcttcggctaaaatggcttctttgtatcggttcatcgaatcccgccattggtcgacagggacatcgccgtacaactctttcattccttgacgaatctcggcttctcttttcccggtcaaataataatagacatcgtggatcaattcaaaatcgtgttcttcagcagattttagataggcacggtaggcaagtcgtcctgtttcaaacattaagccatccatgtcaaaaattactagttggattgtgttcattcgctttctcctactttattttaaaaaagagccatgcgtctagcattagatcgcaccgctcttcgttttgatactcaggtcgattcaagaattgcttttaaggatgctaaatgtgcatccccttgctcataatctctgaccagctcttctgaaaggatgaaagaacccccaactgcgattacttgcggatgagcaaggtagtcttggcaattgtccttagagattccgccagttggcaaaaatcgaacatcatagaagggaccgcttaacgctttgattgcttgtaacccgccataaatatctgctggaaaaaatttcacagttttgatcccaaacgatacggctttctgaatatcatttggtgtcgctgttcctggaaaaatcggaatctgattctttagacagtgatcgataacttctggaacaatagctggagagacaataaactgggccccctttgctaccgcttgttgggcttcttcaagtgttctcaccgtgccggctcccacgagcaacttccctgagcgtgctaagtgttcgattgcttttaacgccagttcgctgcggaaagtcacttcaatcaaacgaatatcatgtttaatcaataattcttctagtggatctagcaacgacatgtctatggcggtataaagcggtaaaactttcgtagccgctaaatgttcggtcaatgattcgacgtttgccattctattcccccgctttctgatcaatttctgcagacatttgcgatttgacaaccgcttcatgcagtccttgcaagtaactaatccccaaagctcgatcatacagaccatatcctggcattgctacttccccccagatcgttcgcccatgatctggacgaatcactccagtaaatcctacatccaccaaggctttcataatggcatacatatctagtgaaccttctgtagacaagtgtgcagactctttgaatttgcggtctcccataaagagaacgtttcggaaatgtacaaaattaattcggtcgccaacctcatggatgatcgacactagttcatttttcggatcggcgcctaacgaaccagtgcatagcgtcaatccattataaggagagtcaacaatagacaatatttttttcaagtcagacaagtttttggtgattcgcggcaagccgaagatctcccaaggcgggtcatccggatggatggccattttaacattcatttcttcgcaaacaggaataattcgtttcagaaaataagccaagttatcgaaaagaacctcttctgtcactccgtcataagtcttcatcagctgattgaatttctttaaccgttcttcttcccaaccaggcagcttgaatccttttgattggctgtggatcaatgtgtacatttcgctaggttccatcccatcaaccactgcttggtcatacagcaatgagaaactgccatcctcattttcataaaaaaaattggtttttgcccaaccaaaaatcggcttaaaactataacaaatcagatgtatgccacaagcagaaagatttttgatcgtctgaatgtaatgatcgatgtagtgatcccgttcttctgttcctgccttgatcgcgtcatggatcgccacactttcgattcctagtaatgtcagttcttctttttcgattgattgttttaattcctcaatttcggcaatttcccaaatatctcctggcagtttgtttaacaaggtgccgatgaccccattgatgccaggtatttgacggacattttgcaaaggaatcgagtctccttcgccataccatctaaagccccatttcatagtcaacatcctttcttaaaaatcatcatcgtcatcctcatcgccagcagctggcgtctcattcgagatatgccaaaaagcaacactatcttctccttgatcgatcactgcttgtgccgctgatgcaattggtgtttgcagtaattgatgattgattgcttctaacaccatcggcaagttggtaccgccaataacgtaaacttcttcttgcagatctttttctaactgattgatcgtcaaaactgactggttgtaagggctagcgctcagtaagtctactaagatcagcaccccttcttgttgattgacttgatgtaccgcggtactgattttttctcccagtgcttgaacatcatctccttgatacaaattgactgtcgctatattttcgactgctcccatgatgactgttgccgcatctttcagtccatcgcttaatgtgccatgagtagcaagtacgattcccaacattgtcattcctcctttgtctccctgcatggatttccatgcaaaacgtttactgtaacaaggcaatcgtcttgtttacattttccatattgatgtctttttgccttaataattgtttaggcagataatatccctctgttgattccttatttccgctgatcacataattgattgttgcatggattccttcttcttgaaggattccgagtcgtgctaattgtttgcgatcaaactctgttcctactacatgtagaggtgctttggcaccaacagaatccagataataaatcgtagccttgcgtttggctgagtctcgcaaaacttctaatcctcgttcgccatagcttccttcatccaagaacgcaaacgcagtgttttgtcgttcattttcactgattaaagccaataatgccaaaaccgaagaagtatttctcgttaagtttttctggaagaccgccccttttaccacttttcccaataaaagaaagtacgaaccaaatgccagaaccaagaaaaatgtttgccaagaaaaaagtacaaaaccgtcagcagcaaattgactatagaaccatgtcgctactgcgccgatcccaatcgttatgaatgagctgacaagaataaaattcattgtttgacgaccttgcgcctttcgatcaaaaaaatgataagcgccaaaatgttgcggcggtgtatcataatacgtacaaatgattcgatctgcttgagcaatatctccgatgtaaacatttctcgaagctgctttatgtttcaaatcatattcgattacgcgaatatcttttcttatttgtgagatatctgtcactaaagcatttaggaatctttttttgctgcggtcacttaagcgagaacgataaatatagcggtaacgaaacagccaatcattgaaacggtctttctgcatctttttcatctcccattcttcgaaggatccagcacgttttcaacagcctttgagctagcaaccatcaaatgaccgttgcttttttgttattgatggaactagctcagttgctgtatttggcagttataatccgaattgtttcaagacctcttttaaagaggatttaggagcagaaggtgttgcttggaaatagatgttttcgactccatagtgttcattcatttcctttaatcttgcggcatctgctttattcaagtagacggattttgtgactaacagatctttttctggatctttctgtgcgatcccgccaatgttcaactctttcattggcacaccatgggtgaccagatcataaatcacactgatggtttttgcgatcaggatgcagttgtactctttaaacgcatattcatcccaataaaattttgctttttctggtgtcacgacaatcgttttttgtcctgtgcgactgccggcatttttgtatagatctcgcatgaatttatccttagcaaccacttcatcaacgacgaagatagagttgaccccgcttttttgagacaacgtcatcatgacttgcccatgaatcaaccgttcatccacacgtgctaaatttactacacccattgttttccacttccttttctataaaatccctacgccggctagaatgatcaagatcaaagtcagccagagcagtgcttgcgtaacttttaagccttttttcgtatagaaccaataaacacccattacaacagccaatggcaagatacctggaacaatctggtcaagaatatcttgaatgataaattctcgtcctgaaatatcaaatttcagcgaagaagaaacattgacatagtttccagctaagacccccatcataaacaacccgagaacagacaacgtttcgattgctgtctgaacaccggtgctttgcatcaatccggtcgcgtttcgtcccattgcaaaagcttgtcgagcaaaaaatacacctaaaaatgcttggtataaagcgaaacaggcaaatgggaacaatgcacctagcggacttccctgctgggcccatgggacagcgatcgcaataaagatatactgtactgttccagaatcgatcgcatcaccgatccctgctaaagcacccatcaaccctgcttttgtgttgtacatcaaatcatcttgcatcagaacttctttgttttcatgttcttcttctgcccgctgctgttccatagaagacatcaggcctgtgatcacgccgcccccccagctcaattgcgtgttgaaaaagagcagttgccgcttataggcagccttgagggcgtcttcgttcttatataattttcgtaaaatcggcatcattgcgtataaaagtgacggtgccagatagcgttcaaatgaatgagggatctcgttggcaaagtgccagcgaagatatgctttcgtgacatctttttttgtgatctcctctggagcgatctgtgttgctttcactgattctgtcattttttccttcctccttgtttcttagaatccatcatcgtaatcgtcctcatcaaaggatgcattggacgtattcgtttcagcagctggagctaattttcctttttgtgattgtacaaagatcaatgcgatcagaacaccaaagattgcgtaagtaaccatagtgatttccaatgatttcagtacgacactcataaaataggcaaggaaaaagaaaaccatgtaatctttccgaccaatgacataaacagtcgttgcaatcccgatcgctgccaagccaccacctactacctccagaatatggatgacgacagtcccttcaagggcattgatgacatcagcgatcagtggtgcacccagataaagtgcgatgaaaacaagcggtacaaataaaataaatgaggccaacgttggatacaaaatgatcgaacgagtaattgcttttgtattcatgtcttccactgctttatccgtatatttccctaaaaatgtattgataaagaaccggaactgatacaaataactgcctaaaagtcccactgggacagcaactgcgatcgccgcttcgggcttcagattacctaataatgctaccggtacagcaatagccgcagcaatcgatggttcagctggcattgagccgccgggagagaagacccccatataaatcatctgtagtgcagcagtaacgatcatcgcctgcgctacatcccccatcacgatcccaacaaccaacccagtcatcaatggcgagaaacgaagggttagtgttgccccaccaccaagccatctagacatgactgccgcaacccataaagcaatcagtaaactctgtgtaatgcttaaagtttccatttttcctcctcctaaacctgctcgatatagttttctaaatctaaaagtgcttttttcagccgttctttcgttatagaaaccggaatcagatgaactttctcttttgaatcaacaaatgccactaactgatcgatcacttgcgggtcttctggatagatccccatttgatgcagggacattggcaactgcaattctcgataaaacggcaataactgatcaatgaccgtccatctttcttcaatcgctaattgataaaaaatgccgtaagcaactttttcaccatgcaaaaactgatgacttgctggtagatatttgctgattgcgtcatgcatcgcatgggctgccgcattgcgggcgtatttgtcacccaatccaccaactaaaccggcaactgcaaacacaatctctgacaagtgaatgaattcttctgttaccttttgctcttccatatcttggattgcttgttttgactgagatacaatcgctttctcgcatagtttggctgtgtagccagccaattgtagaaaaggctcatgttgaagctgtggttgcgccaaaattgtttctgattcataccactttgctaaggtatctgctagtccagcaataaagtaggaaactggcgcatcaatcactagtgtcggatctgtaatcaaaaaagctgcttgccgcaagaagtgctctgacattccttcagattcgccgttttctttatacatcacagctaacggtgtccatggtgcacaattacttgctaaggttggcacgacaccaaatggcgtattggtcagatgggctgcgtacccgaccaaatcggtcaattttccgccgccgacaccgatgataaagtcaatgtgatgtgcttctacttgatctttgatcaaatttgcaccgtagtaactgcattccccagtatactgatgataaaaaacatcctggggcgcctcgttgataaaagtcaatttgggttgcgctttttgccatgaaatcgagccatgaacgattaataatcgtttggcttgatattcttgcagcagctctggaatatgggctaatgcaccttcatggtaacgataaaactgaggaccaacttttacttttaaatcagttaacatttccttccctccttatgagaaaacaagaaaatcgctttgatcttgaacagctcgttctggtaattgcccttgaatgatctgttcgatgtccgtcacacatttttctcccatctgttcgagacactccattgtgtaagcagacgtatgaggtgtcatgattacgttatcaaatgccaggtatgggtgatccttgcgccccggttcttcttctaaaacatctgtcgctaagccagcgatcttcccggattttaaaccgtttacaattgcttgttcatctaaaagtgctccgcgagcactatttgacaaatatacttggtctttcattttttcaatttctttggttgaaatcatatgataattttcatctgtcaaattggcacacagacaaatgatgtctgaacgagtcagtaactcatctaactcaactttcttcccgccataactttgtatgtggagtgctgattgatagggatcataggctaatacctcacagcgaaacccattgcgcaaaatctccacgacacaacttcctgtgttgcctacacctatgacacctactgttttattgaacaatgctcgcccgacgaatttggctcgtgactcccattgatcttgccgaactttcacagatgactctacggtacaccgcaaaagcgccaacagattcgtcacattattttctgccaccgcatctcgttccaccaatgctgggatgatcgaaacgatcgtttgatggttacgtgcagctgctagatcgatattgttgtagccaataccatgacgagtgatcaataatagctcatctttgtgttcaaaaaattcctctgtaaagtgaggcgtcacactggcgatgatcagattataaccttgtaaacgttgcgccaattccttcccggaaatgtcactttccacatcaaaatgagtcactgtgccgattttttcgagcctctggatatgttgaggaaatattttgccaaaactactagagttgactatcgcaatcttatactcaagcatcctaagtctccttcctttattccgtttttgttacgatttcgtgtccgccaaatccatttctcagcgcagacaccacttttgctgagaagctgtcttgttcttgtgataaatttctcatgaaaagacttaatgcaattgttggaacggcaacgtccatttccagtgctgtttccaccgtccatttggcttctcctgaagcagcaacgataccccgatattcttctaagtgggggctgttggaaaattgtgcttcggcaatctccatcaaccagctgcggattaccgatccgtggttccagacatgggctactgctgctaaatcaaaagcatactcactctgctcaatcagttggaacccttcaccgattgcttgcatcatgccatattcgatcccgttgtggatcatcttcaagaaatgaccgcttcctgatacgcctgcataaagatatccgccctcaatagcaacatttttgaatacttgttcgatcgaatgaaaggcatttaagtcgccgccgaccatcagacaagcattcttgcgcgcaccggagattcctcctgaagtgccgcaatccaaataggcaacctctttgtctgaaaattgtttccctcgtcgaatcgaatctttataatttgaatttccaccttctatcacgatatcttctggtaaaacaagtggcagcaagtcttttagtaccgattctgtgatttcccctgctggcagcatcagccagatgactcgtttgccagtaaatgaagcgaccatttggctgatagtctcatatgtttctattccctcccttcgtgcagcaagtcgtgcttgttctgaaagatccagccctttcgttcgatagccatgatcttttaaattgcttgctaagttcaagcccattttgccaagaccgataataccaatctccatgatagcgcctccatttctatcttcattatacaaaaaaatatttttttgtaaatataaataataaaaaatattttttatttgcatttctttggaaatcgttgtactttaaaaatgaaggcttcggaatgtattgaaaaaggagaaaaacactatgactatatcgattcgcttaaaaatcaagaccctctataaagacttaagccccaaagaacaagcaatcgccgattacatactcgaaaaccccagtaaggttagccatagttccattagtgatttagcaaatgagctaggaatggcggattcgacattttttcaatttacaaaaaaacttggttacaacggttttaaagactttaagatggccatgttgatgcaagaaaatgatttatccgccatctctttccacgaaaatattcagcaatcagataacgagctgaccatggcgcgcaaagtctttgattccaacctcaccacattgaccgatacgcgaaaactactgcaagaagaagatttgaaacaagccgtccaaatgatcgacagtgccaagcgattgttcttttttggcgtaggcggttctgaaatcgttgcagctgatgcataccataaattcttgcgctcaccgatttctgtcgttcacagtgcggattatcacattcagttgatggaagcagcgttactgaccccagaagattgtgccctgttgatttctcatacgggtaaatcgaaagaaacgattgaacttgcgcaagtcgccaaagattgcggcgccaaagttatcgttattaccagtcacgcagcatctccgctagccaaattaggggatgtcgtatttatttctgtttccgaagagatcgaatttcgttcagaagctcttgcttccagaatctctcaactaagtatcatcgattcgctctatgtgattttgatgtttatcaaccgcaacaaatcccaagactccattgcgaaagttcgacgtacgatttctaaaatcaaagaatagccttctttaaatagcgtagcagcctaatctttaaaacctttcaatcatgtactaatgggttatgaaaaagtaatttcctctgctctcctttctttggacttcagaggattgatggctagtctaaataaaaaccaaagctaacgattaaagttctgataccgtctaagcacaagcgtgttcgatttttagtccatgataatagaaaaaagcagactgtctttcctcatagaaaaacagtctgctttctcttgttaaaaatcctcacaagtcgcgatgatcccttaagcgataaccgagaccaatctcagtgatcaagtattcgggactgatggtattggtctcgatcttttttcgtatatttgacatattgacccgcaatacttgcggatcagtgccataaggtccccaaacttctgtcgccaacgtttggtacgttacgactttgcctagatgttggaacaaaacagttaaaattcggtactcatttttggttaaatggatctctgttccggccttagtcaaaagctgcctttcagtatcaagtgttaattcaccattcttgatgactagcggcattggctcttgcttccgatgcctgaatgctgtgcggatccttgcaagcaattcattcataccaaatggcttggtcacataatcatccgcaccaagatccaacgctttgactttctcgctttcattgctgcgagctgaaatcacgatcaatggcaccgccatccgtttgcgaatgattttcaataactccatgccgtcaatatcgggtagtcctaggtcaagtaaaatcaaatcaaaggattgttcctgaaaaatcgtcagaacagccattccagtctctgctactcgaatatgatacctttctttttctaaaacgacttccataaaatcggcgatcgtcggatcgtcttcaatcagcaagacagttcttcccatgatgcccacctccagttaattcaaataaatgcgtacgaccgtttgaccatctgctacggccatctccaacttgccatgatgggcatgaacaatggttttgacgatactcaagccgatgccgagaccattttttgagtctaccggcacttcattgtctgaagacagatttgattggatccgttcaaactgcttcatcgatatttctccggtattttttatttcacataccgttttcgctccttcttgaaagacagacaagtaaacttttcccgaatctgaaccatgacgaaaggcattttctaccaaattaaaaattgcttgttccatcaaaatcggatctacctccacgaacaggaccgattccggcagctgaacgatcaactctttttccggatagacttttttggcatgttcatagactgcaccaatgatttcttcaattggttctgcggttttcttgacttgcatcgtgtccatgttgatgcgagtgatcgaaagcaaattctccaccatgcggatcagccattgagactcactttgaatgtctgtcaataacttgctgcgagtcgcttcctttaaagagttattagtttgtaagagcgtctccgcaattcctgaaatcgccgttaaaggtgtccgtagatcatgagagatggcccgcaacaaattgctgcgaactttttctcgttcattttctaattcaattttttctttttcatccttcaattctgtttgttctaaaatcacagctaactgggtcaacactaagcgcagataatttagttggctgttctcaagtggaaaattacggcttctgcgaatgcctaaaacggccaatgttttgctgttggcaataatcggtaaataaaatccctttgcaccacttaatgtatcggtcccatagccagactctttctgatttttggcagaccaataagcaacagccgcttcttccggatgactcaatgcggattgtttttttgctccatattggctttgtttttgcgcttgtgcatcatacaaaatcacttcgcgatctaacaagcgggccagataggtggctgacaaatcaaaaatctgctgccggtcttctgctagaacaaattgcttgttcagctcataaagtatttccatctgctgttctttttccattgaatgaacagcttgtttttttaaacgaaccattagattactgatcattagtgcgacaagcagcatgatgactaacgtaatcggataaccttgtttatagacggtcaaggagtacagtggttcaacgaagaaccagttgaaggctaggacgctcaggatcgaagaaagagcgctccagaaatagcctgaagttagacgcgccacaagtagaataaaaaaaatgtagacgagcatcaaattctgatcaccaaaatgcaaatactgcatcacttcagtcgtcagtgtcgctaagaaaacactgatcagggcaatcgctagatcctttccccctccttcaatgactttcttggaaagagaaaaaatggaagcacgctcctctttgtaaggaatcaaatgaatctcagtgtcaggcaaccgtttcagtagccgcacatcaagttcttccacaaacagtttctcataccatggcttggccaggtttttacccatgatgatgtcggtggctcccaccagcttggcatattcgatgattgtttcaaaataattgtcttcttcaatgacaacgacttccgcgcctaacttttcggctaatgtcgttgcttcatttttttcttccgaacgtatgtaaagcacagtccattcagcacctaggccttgcgctaatcgcgctgtccaacgaatacttttttctgccattttagggaatgcatcctggacaatcgtgatcagtttgctctggattccattggttcggccactgattcgattgatgtggtcagaagcccgctgaatcgccaatccccgcagttgttccagttttttgggaataaaaaaattctgcaacgctcgcttggcattttcgttggcatagatttttccttgtgccaaccgatcgatcagctcatccggctcgacatcgatcactttcaatgttgcttgttggaagaatgtatctgggaccgtctctttgacttcgatcccagttacttcttctacaatatcattcaagctttcaatgtgttggacattgaccgtcgtatgcacatcaataccggcatttaaaagttcttcaatgtcttgatacctcttgcgatttcttgatccttcagcgttcgtatgggccaactcatcgattaagacaatcgcaggctgctgctgaatgatcgcatcgatatctggttcagtcaacgtgatccctttgtattggatttctttcaacggaatctgcggcaaaccagccagcagactattggtatctggacgatcatggggttcgatgtagcctatcaccacatctttgccgagggcttttagttcctgtgcttctaaaagcatggcgtaagtttttcctactcctgcagcaaagccaaagtacacccgcagccggcctttttttcgattttctgctttcaatgtatctactgatgttggtctatccatgtttgcttctcccatcaacaatcacttacagtttatctaatgctaaattcagttcaagcacattgacaaatgttcgatcagaaaaccaatctttttgtgtcttttcttttattatagcacgaatggctgtttccttctgtttacgttctttggcgatgcgaggtacttgtatctcggctgcagcgacactaatatgcggatctaatccgctggctgatgcagtcaccagatcaaccggtacctctgtgatttgattttctctttgaagcgcggtctttctgtcggataccagtccctcttgttccgcagagaccggagacaattgggagaccgcattgcttctgccagcaaagtagcctggttgcaggaactgctgaccaatcagtgttgaaccaactacttctccctctaccattcgttgactaccattggcttggttggaaaatagcaattgaccgacaccagtgatcacagccgtatacaccccgccaaaaaacaaaatactaaacaccaagaaacgcaattgagtccctagaatctttttcatttctgcatccttctttcaatttgttcatagtaggaaaaagcttagcacgatatcgatcaatttgataaaaatgaaaggtgcgatcaatccgcctagtccatataccagtaaattgtggcgcaaaatttggctggctggtttttctttgtatttgactccttttagagctaatggaatcaaagcaacgataatgaccgcattgtaaatcacggctgacaagatcgccgtcagtggactacctaactgcatcacgttcaattgcgccagttcaggatagatgccataaaaaagaacagggatcacggcgaaatatttcgccacatcattggcaatgctgaatgtcgtcaatgcaccacgagtcatcaacagctgtttaccgattcgtacgacctgtagcaatttggttggactggaatccagatcgatcatgttgccagcctctttggcagcctgtgttccagtattcatagccattgccacatctgcttgagccaatgctggtgcatcgttggttccgtcgccggtcatggcaaccaagtgtcctttttcttggtattgccgaatcaattccattttgttttctggcgttgcttcagcgaggaaatcatcgactcccgcttctgctgcaatcgctgctgcggtcaacgggttgtctcctgtgatcatgatagttttgatacccattttccgcatatcggcaaaattttcctgtacaccgtttttgacgatgtccttcaaatagatgacccccatgacttggtcatttttgacaactaccaacggggtacccccagagtgcgccactttggctacgatttggtcacactgtggtgggtaggtaccgccacgagcgagcacatatttcttgatcgtatccgccgcacctttacgaatttgatcgccacgataatccatgccgctcatccgtgttttggcactaaaatcgataaatttcacttcggattgttcaaaagcgcgttctcgaatcccaaatttttctttggctagaataacaatactgcggccttctgccgtttcgtcagctaatgaggaaagctgcgcggcatctgctaattgttcttcactaataccggctacaggtagaaaggcacttgcccgacgatttcccagtgtaatggttcctgttttatccaataacaaaatatcgacatcaccagccgcttcgatggcacgaccgctcatggcaataacattttctttcgtcagacggctcattccagcaatcccgatcgaagagatcagtgcaccgatggtcgttggggctagacaaacgagcaatgcaataattacaatactagaaagcgcggttcctttttgcgaaagaatactgcttaattccgtaaatgggactaatgttactgccaccgctaaaaagatgatcgtcaatgtgatcagaaaaatctgcagcccaatttcattaggcgtttttttgcgttgtgtcccttctaccattgaaatcattttatccaaaaacgaatgtccattttcagacgtcactcgaatgaccaagtaatcggaaaccactgttgtcccgccagtgactgcactgcggtctccacctgattctcgaattactggcgctgattcacccgtaatggcactttcatctaccgaggcagcaccttcaatgacatcgccgtctgccggaatctgttgtccagaaacgacataaaccaagtcaccttttttcaaatctgatgacttcatttcgatgaactgctctaattggatatcctgtaaatcattgattttgtaagtcatgacatcttttttggcttgttttaagctatctgcctgagctttcccacgaccttccgcgaccgcttcagcaaaatttgcgaacagtaatgtgagccaaagtaagctggtgatcgtgatggtaaaccacaatggaatgtcagattgttcaaagcagagaaccgtcgctgcgatggcaccaatataaaccacgaacatcactggattttttatttgttgccgcggatctagtttgagaaatgcttgcttgattgcccagcgatatatctttttcattttattcttctcctttttatttcagtgtaagaaaatctgcgatcggacctaatgccaatgcaggtagaaaacttaatgccccgatcactaaaatcacaatcatcaacatcgtgacgaatgtcggattgacggtagaaagagtaccgtcattcacagctactttcttcttgcgtcccatgttttcagccaaaaataaaacggcgatgatcggaatataccgagagaaaagcatgagtccactacctaagacattcaaaaatggggtatctgctaacaacccattaaatgcacttccgttgttattagccaatgatgttgctccgtataacagctcactaaatccgtgagcccctttgttggtcaaccattccaaaatatccgggtgcatcgcaagcgccatcgccccaaacagcgtcagcagaagcggcgtcaaaatgactaaacttgccattttgatatcaaaggcttcgattttcttgcctaaatattctggtgtgcgtccaacaagcagtccggcaatgaacactgctaaaagcagaaatgctaacatcccataaagcccgctaccgacaccaccaaaaatgatttcccctagttgcatgagaaacatcggcactgcaccgcctaatggagtgaagctatccaacatcgcgttgaccgatccattggaagctgccgtggtactgactgcccacaaacttgaccagccaatcccaaagcgaatttctttgccttccatattggctgaaccaacgacatcgttgaaaatcggtccatagttttcactgatcaatacacctaaaaaagcggcaaataggaagaacagcgaaacaaataaaatcgttcgtccttgtttccagtcttttacccaaaagccaaaagcaaaaatcagcgcagctggtaaaaggagaatggctaaattctcgataaagtttgaaaaaatcgtcggattctcaaatggataggccgaattggccccaaaaaagccgccaccgttcgtccctaactgtttgatagccacctgactagcaacagggccaagatataaccaaagattttctccttccaaactgttgtaggccattccgctactgaaggtttgaacgactccttgagagatcaataaaatcgcaatgatcgtggacagtggtaataggatatacaataatccgcgaaccatgtcttgccaaaaattgcctaaataggattcttttttctgaaccaatccacgaatgaatgcacaaagaacagccaatccaactgccgccgacaagaaattttggacagtcaaaccaaagacttgtgtactattggatagtgccaactcgccagaatatgcttgccagttcgtattagtgataaagctgacagctgtattaagtgctaaatcaaaagacagattatcaacctttgctccacccggcagccaaccttgaaccattaaaagtaccgtcaaaaacagcagcgaactgattcctagccctaatacactgatcaaataacgttttgcggacatttttcgctgactttctgaaccgatcaaccgatagaaaccgcgctcgatcggttggataaagcggacgaaacggggcgtctcccccgtcatgatcatcttgatataaaaccctaaaggggctgctaaaatcagtaatacaaaaaagaaaaacagcccttgaaaaacaaagctcatcataactcttcccccttgaacagaaaccaaaatagataaagcatcaatccaaaactcaaacatcctaaaagtagtaacatcttcttcctctcctttgatcttatcttaaaaaaaatgttgtaaagatagtatcaaggttcgctggatttctttatatcttctttatacgatgagctgtaacacaatctgtctgtttacagcgaattagcggatttatcttcttgcccaccctgttatatttggttatacttgtctcacttaatctagagaggagcaatcaataatgcagtttacgatctcgggtctggtcttaatcccgttatttcttgttacttgctatttgattctgcgttacaatgctgctcagctttcactttttcaaaaaataacggttggagctttgttttctatagtttcgctgtcctttacttgacttttttcccttttcaaatccaaacaggggtctatgccaatcaatccgattggcttagtcgcatcaacttctccttagcagcagatctttcgatactccctaatctcattatgttggcgccattagctgttttttattatttgatggctaacaaaacttctatttttcgagctgttctgctgggattttcggtcagctttagtatcgaagtactgcagtttttaagcaattatttcctaggcggctggcgaggggcagatgtcgtggatttgattgcaaataccgttggggcattacttggttatttactcagtcgctttcttttcactgtgctgcctgagcgatcctttcttagaaaatttatgcttcattcccctagtgagtcgtaaatcaactatcggagcaagcaaaaaagagcccgtcaaaaggctctttttcgtatctgtctattcgaaaagaaaatcttgcagttttactagatgggtattgctgttgccggaaatcaagcagatcactttgtttagcgatttgttgaaacgatcgtggcaccaaaaggcatcaatgctagacccgctagtttcagcgactgtttcgcaaaaggaatcccaataatcgtaatcgttaagagaatggcactcatcagatgagcgattgccaaaggtattcctgaaaaaatcagccacaggatattcaatagcaaagaaacccctgaaccactatagacaacttcttttccaaaaggagccaatgataaagaagcgaatttaaaacactgcaaaccaatcgggataccgatgatcgtcacacaccacagacaaccggccaaaaaccacgaaattgcaccaagcaatccaccaaaaatcatccaaatcaggtttcctaaacaactcatactcatcacattcctttcctttgaaaaaagcggccatcatagatgacgaccgccttgcattatccttcgttcgtttttgattacattcatttagccaactgcttattcgttagaatttccgccaaatacacccgtgatcgaagaccaaagtccactgaagaagtttttaacattttcccatagtcctttggatttttcttcaatttgtttgcgggcttctgaaagatccaactctttgacaaaatcttcaaaaatatttttgtctttcatgtcgctcatcaatgttgtcaattcagtaacttgatccgaagtcacgattccctctaaaccattgtctttcaatgctttttcaacagttgcttgaatatcggattgggtcaattctgagccatcagctgtttgggcagctagctctgttttcgcttgttcttgtgcagcattcagagcttcatcagaatagccttctttgtctttgttttcttctgtaatggttgataagacatccatttcatcttgcgcaacactgacacgatcttgattgatgatgccgccggattcttcaacgattttgtagactcctgccaatgccccagaaccgtcaatcggtacagcagaagctactgttagcttagcatctgtgatcccagcagtcagtgcggcattttggtattgtgcggcagtgatgcgggtgatatttttaggtgtcgcaatatccaccgtgattccttcgccactatcaagggtctgcatgcggacagaactatacaccgcccaatctttagtaaagccaccatcagggatatatttcattaaatcggaacctgaagtcgtatagatcggtgtttctcctttgatccccagttgatccagggtatagttttcttgctcttttgttaatgcattaccaatggctaccgcattgatctgcaatttttctttactatccgtcgtagaagtcgcagtttctgagcttgctgtctctgaagctgccgaagacgaggtttcgatcgtttgtgagattgctgagcgcccttcacttgaagttgattcttcagcaaatgctaatggtgcggcaactaaaacttggctagaaaccaagagagtggctaaaatcatttgtttttttctgatattttttttcatagtatcctccatctaactattttcctgtttctattattgtactataagagatacgtttcgacctacggctagggtcggatttgaaggaaaatttatgatctacttgtttaatgaatcgaaaggaatgtttttttatcagaaaaaatagccggttgaaagggaatcgtactatccattgaacaatacagcagggtctaaattctagtctacgttataaaaattattttcttgttcacttcaacttttttctttaattcatatttacattcaatattcagaaaatactggcattataggtaaaaagaactagatagattattattcgaactaaaccttacaaagtggcaaaatttattttactacagataagcaactgaaaagagaataaatctagaaccttaatattcaaaaagactttgacataggtctgatactactttatttcatattaatcgtaaatcgtaccgtcttatttatccgtatatatctttttttgtaaattcactctgctcttacttaaatagattgtaaattaatccaaaacgaatacgagagtggagcaataatcagattttcttttgactattgctccactctggtattttttattactaattaatatttctctgaaatatgttactcaaaaaactagtaatctaaggccttataatatcgacggatatctaaaggatgcttgcgaacattttctaaatgcacacttagtctcataaatgctgatctcattacaattggcgatagtatccatctaaacttgtcacttattcctacaagttcaaagtcttttgtgtcaaaaactgtcactttattacttactcgatgaacaaaattttctacacgatccatttgaccacgtgttttatcttctcctttaagtaaaacaacagggatttctctatctattacttccaatgtgccgtggaaaaaatctgccgcagagattggtcttgttggcatccattgcatttcttccattatgcacataccatagcatactgcccaagactctaaatttcctgagccaattagataagtgagtggttcgttccaatacttttctgcgtaattttccattgatttatctgcttttttatacacattgacaatattggaaggcatagattttaattcatccataaacttctcatactcttcaaattgtccagctttgttcataaatcttaatagtacactataccaccagtagtattcagctccaaaagtattcgctaaataatctactttttctgctaaaggtgtatttaactgctctacatatcctatgactctagctccaacttcatgagcgatatcaattgctttttccacttccactgtatgccctgacaatgaagctattacaacaaccgaatctttcgtaaaattagcatttccttcataaacaaagtcttgtgcgttttccagatatattggcagctggcatcccaattgttttactgtatgaactacttgatctgcatacaaataagttccaccaattcctagcaggaaaatattcttatatccattatcaacgatttcatcaacaatcttttcaactttctttacaagatcaaccccattttgatgttcttggtaaattctttcttcattaaaatttaacattgtcttactctccttagtttaaaattccaaattgggcacaaatgatcccaaaaatagctgttcctataatcatccataaaacgtttacttttttcttcaacaaataatagtaaaatccagtaattcctaaacttagcattcctggtaaaattccatcaagaatttcttgaaatctagtggccgactcaccctctccaatagtcaatggggtttgcacaacaactaattcatttgtcatacctccaatcaccataactcctaaaattgctgctgcgagcatgaacttactcattaagccagttttctgaattttttctaaataattagctccgagttcataacctttgaatgagcagaaatagcgcaaaataaaagctggtacattaaatatgattaaaaacaaaattgggcctaggatatttccttgagcagctaaagaagctccaatgccgactgctagtatacgaagggttcctaacataatcgaatctccaataccacttagaggtcccattagagctgctttaacagcattaatcgatgatgtatcaaaatcaggatttgtagcattcatttcttccatagctaatgttactccgcctacaaaaggtgagatatgcgaggtgatattgaaaaactctagatgcctttttaatgcttgagctaaaccatctttatcatccttgtagatttttcttaaacctgaactgatcatggaacaaaaacccatatgcatttgtcgctcataatgccaagaaaattccattgataaagaacgccaaaacatttttctaaggtcttttttagtaattactctatttgtttcattagaagtcatcatcaatatcctcacttccttcagcaaaagctacatctgaatttttgcttgttgtaaaattgattttcacaaaaattgtaattaaccctataatagctatacccactactggaatctggaaataagcggataacacaaatcctagaaaaaagaacggaactacttctttattcataaccattctagctaacatagcaaaaccaatagctggaagtataccggtggcaatagatagaccatctgtaattactgaaggtatagcattcactacagcccccatttttgaactacctaaagaaaaacctaaaaaggtaataataaacaaaactgtacaagtaataaatccagtaatcatatgaatcgcagtcacttttgaagcctcacctttttctgcatagttatctgcaactttggccataaaaggacgaactaaagtaaaaataaagttatcaactacttgtgccaatagtgctattggaaatgccatagtaaaagcaatatctgcacctttaccaactgttatcgcaaaagctgtacctaatacaccacctacaattacattcggcggaatataagcacctacagagacctgccccaaaaatgctaactcaagtgtagctccaattgttattcctagttgtaaatctcctaaaactagcccaactaatggtcctaatacaatggggcgttgaatcatgtttgtccctgttgctaaatcacacttccctataaaagcaatacaccccaataaaaaagcttgtagcataagtttattctcctttctaatttatatttttcaaaattgatactgcccttatcgctttttcgcctggaaccatccgaatctctacattcactcctaatttgtctaattcttttattatttctatttctgccattgttatatttacagacttagaaatattttgtgttccatttgttgccttggttccacctagattaatttcttttatatttggacaatttttggctaagttaaatgcgtctttaattgattccacaacaataaagagcttatatttatctgttacaccactgttgatagcgttaatagaatcctcaatattcttaataactaattttactccttgaggtttcgctaactttatggtggtttttctgaggtcatttgtcggcacatcatcattggcgatcaagatacaatctgcccctaagctttgcgtccaagaaaatgcaacttgtccatgtaagagtcggtgatcgactcgtgtcaaaataatcatgtcgttcctcctaaaattcttcttcttcgatttcttttgctacactctcattgcagaactggatcatatctttcgaattagccaacgtttggtggatcgtttctgagatggcacctcctccttgaagttgtgttgtcaattcaatcaacaatggcaaattcaatcctgcgatcaagtagaaattcggttgttggatataacgtaaaaattcattgttcacactgccaccgaaaatatctgtgataacgatcatttcgtgctgtttataggtttccatcagtgtatctatagttgctgttagatcgaatgcttcttgaacataacaatcaatggcaatgactgattgtttttttccacaaataagttctaaagaatgcaagattcctgatgcaaatttaccgtgtgatgctaaaataatgatttgctccactgctttcacctctctttgcgccaagttacactttattaaacgcaaaaagcgtgccaaaaaaagtggcacgctttccttatcgattaaaaatccgcttcaaccattgaagaatcagtgtttccaaataaaacatcatagatatagcaaacttcagattctggtatcgcgacactgtaaaccttttcaatgacactaaacgcctttttgatctctttcagctgtttttcatgacactgaagcagtgtgtcgctggcatgataattctcaatggcttcatttcgaatcagtcgttcgatcaaacaacttgtatggacaaacaacgcaagcttgcggtcattagtgattctttgctgccatatacgttccagattccccacaaagaattccatttgagaaatcactttctctgtatctagaatcgtcacagattgaatcactcgatccagcgaaaagtttcttactaattgattgttcacatacgcaatcatctcttcatccaattcttctttcagccaacttaatagcactgctgtacctgcgccagaaatcagttcttctaaagaaataaaaggagccagctcttgacgaggtttgttggttcctacaacaccaacaatgtcatacgatgtcaaagcctgtttgacatgttccctattttccaactgattgaactcataagggagaattcgaatctgtaaatgatctggaatgctcttttctaataaatttgagatttgaaccgcagttccaatccctgttgaacacgttgtgatgacaactttctcttttttcgtttgcggaagaataatctcccattcattttgactgtaggcatttacccgttctggaatttccctcagcgaaacattttgctggatacattcccccacagcgatggctacacttgtcgttacattgttcatcatgacgattggaaccgtcaattctggaatatactgatagatttctttcaacgaacccatgtcgaacaagaccactagtccattagatacatcatttttttgaatatatgcggtgaccctttctgcaatttgcttgggcgtgacatctaatggcatatcgaaagactgaaaaaccgattcattcaacaaacgattcgctacattcgcaatgctgctggcagttgcgtagccatgagccacgatgatacttctcggaagcaatgaatctttggtataccccatatcgttgatatagagtgtaaagataatgcgatccatactggttaactcgatatccaatgctttttgtactagccctaacagattttcggtgtagcgatcacttgtcgaataatgctttttaacgctcttcagtaggttctctgtcaataaaagtttgtcttgatcatccggcagccactccacatttcgccgcagccataaataataactgatcgtataaaccatgctgccgttaaagctgatttggaaggaatgttcaatctgttccatcattcgctggacatgctcggtcacaaaaatcatcgtccgctgcttttgttcttgcttatgatcaaacaataaattttcgaatagtctttcaatcactttagaaataggatcagctgcagctgtaaaatcctgtcctgcctggacataattgagcaggatctgttcatatgtttgaatgatcttttgttgttctggctcactttcggcagtcagctgctggatttgcgtttgcccatcgataagaatcgattgcgtcgtcgctgactcattgggttcatctgtcaattgcagtaaatgttctggtaaatgatagaccgtgactgctatttttttggctttccgctttagactagcagtatagcttttggcagtaataatcttgatcgtacttttcaattcaccgacattcccagaaaaatgactcgtcgttaacatttcgatcacttgaggtgagagttctaacggcaaaccgatgcgcttttgctcttcaaaaaatgcttgcaagatcagttgcttccgttcagaaatcgttcgttcttccaaagcaggcaatgtcgcttggatcgggattcgccgcaaaaaagttgttagaaaagtttgtttcaaatcttctgtcgttgcaaacaccaaccgacaatccaccgtgactggtcgtcttgtatcccccattcgatagatgacaccttgatccagaaaagtgaataatttttcctgtccttcagcattcaaccgatgaacttcatcgagaaacaagacaccgccatctgctgcttcaaaagcaccagcacgatcttcctctgcgccggtaaaagcccctttgacatgtccaaataaattactagtcaatagctcttggttgttggcgtactgtgcgcaattgatggtgatcaaaggcgcatcgacctccaataattcattggccacacaatagtgatggaacatttttaccagaaaactcttccccgtcccactttcccccgtcagtaagaagggaagcccaccatttggatagaaggcggccatcttgatctgttcaatgacttctgccagactgcctttgctgccgatcacactggaaaagaaatcttctttttgatcaaaaaaaggtttttccgccgcaacagcagccagactctcgtatacgttttgtgttaaggggtagttttggctctcaaatgcctgcttatgaaaaaaataaacgggtcgggtcgcaattttcactaaacgactttcttccgttagctgattcaaatagtgactgatcgtgtttctcttgactgaaaacttctcggcaatatctttcgctgtaaagatatcgcttacattttctgcagagaaaaaagccgtctggttttgcaagtaagcaagtaattgttctttcatcgctgttctccttgtcctctttctccgtttatcatagcttacgattcttaaaaaaccaagaggtgacagaggaagttgcttggaatgaataatttcgaggatatttccctcaactataggtcatcttgaaaagagtccttagcataaaatttatgatccaataaaaatcactcaaggcagtcacattttttttagaccgttcacagatcttgcccttccgctagagactcttttcattttcatagatacctctatttcttgcaatctaaagtaaatcatcaaagctgacggttccgcaacaagtcctccctttttattcctttacaatactctctacttattgcattctattcctttcttaaatcgttacttccgtatgatcccggctcaaggtatataggctggtttcgactttgaagtagtcttcgactaattttttcaactcagccattgcggcatcagcccgtaaatgttgttcttcattgattgattcaatgaacaatactgcgttgacggtctcttcttttaacatcgtgcgttgcgcttctcgccaatttaaacagcggcagatggctccttgctcgtcatagtaaatcaattctcctgctagagctggcgcatccgcctcggcgcctaatgggaaaaatgactccccacccttggctagtccaaggtgtaaatcacctgcgattgcagccaaatcttctccacctaaaggcatcccatacttcatagagacactattgtagagatctactaatggattgattggaaaaaaagttcgatcttgattgacacgcttcaacaatgcttctatggaagaacgggcacctttttttgttttaaatttttggaaagcttcccgccattcttggacaactggattttcactgaaggttgcattcgttaagaatcgcttagcttcgcgcttaccgttttccagcaattccgtaaaataactttcttttgcaggatctattgaattgtcgatccctttcacaacgagacaactaatttgtgcttggggaaagatttcccagaatgcttgatcaattactattttcttcattgctttcacactccaaatgtattaataaaaaagcggcaaaacaatatttgctagttccgccaattgattccaaaagttgatcattatttaaacctgtccttttaaactagggaaggttgatcacatttttgaaaaagaaaacgattttctatcctacagtgccgatttctcttgccctatctaattagtagtctctttttccaccattctttacaatcgcccaatccgattcaatagattctctgatctttgaaagtaaatttgacaccgtttctatttctgatgcggatagttgagtggtagcgattttgttcgagtattcgttttctcttaagataaactgcacaacatgctttcctttttcagttgtgtataaatgtttgatttttttattgaacggatcggattcttttaaaatgaatccattctcttccaactttcggacagctcttgacagcgttgtccgatcgactttaatcacctctgctaatcgttcagggataatcccctcattctcaaaaatacgaaccaaataaatatactgccctttgttcagctttaactctttaaattcaatattggcaatggcatcaagcattcggctaatcgagccaatttctcgtaaaatgtcattcattcttctttctcctcttctatcattatcctacctttttattgttgcaaatgcaatattttttcggaatagaaaagagcgaaaccaatgtttcactcttttaaaaaatatttttatcacttatacattctgttgctagttgatcatatttcgccaaccacatgactaacaacaaagattgtttcatttgctcattgcttggaggaagagagctaaaccattgatcattcactagaacccgtcagaggtatcttctatctaaagactagctgattttttccctcagttcgttttgtctgtttttctgacacgtattctcttttattcaaaaaagaactctttagaattgtttctttttcataatcgaaatactgatcctcacagagagtgccaaaagtagcatagcaattactaatgcaataagaaagagcattcccatgctgacaatgggcaatgtgttcaattgagcaatcagatcaacattaaagaagagctttgccccttttacaattacaacaccagcgactaccagaagtccaacagcaccaataatggcaattctgcccttttcgccgccaaactttagttggaagggaaacataatagattggatgatgatcatgatcggcaggatcattgctgcaatctgccagatctcagtgagagaagtagtatctctaacaactgttgcaatcaatcctaagaaagttgccaaaagccatgaactaaatcccagtaggaatcctagacaatatttttccagcacatagcccactcgagtaataggtaaagtgaataaaaacgcatacccattgtcaaattcatcatagctgatagtgcttaatgtgaataaagaaagcgcaaaggttaagaaacctagtgggaatgatacatcctctgtaaacgagatcattcctattacaatcaaaagaataaccaaaaagaaatttttttgtgtggccatcaatttaaaatcttttaccaacaaacctgtcattattcacgcccccttaccatcatcataatcacttcatcaattgatcctttttcaatgactattttaggaaaattctccatataaaattgtttttgattcgttaaacaactatacccatagctttcttctttgtatcggagaataaattgtttatccagttctttgtattgctccggatcaactttcaatagtgcataatcacttaacaagacatcggtctcttcgtgtaagatcattcgtccatcatggatcatataaagatcatcacaaagtgtttctaaatcactagagatatgggaactgatcaaaatcgcacactcttcatctttttccatgaactctctcaacatcaaaagtaattcatctctggcaatcacatccaagccagctgtcggctcatctaaaagcaacaatttagcgtgatgcgatatagctactaatacttttagttttgctttcatccctgttgaaaaatcgttgagtcttttatccactggtagttggaatcgctgaatttgttcggtaaaaaagtcttcgtcaaattcgctatacattgtccgtaaaatcggaacaatatctttaatccttaaatagccgctgaagccagaatcggataaaacaacacctaacttttccttctcttttggggtgagttctttactatccttgcctaaaagtgtgatcttcccactgtcaaaaggaattaaaccaagagctgctttaaacgtggtacttttacctgctccattttgaccaatcaaccctgcgatagtacctttttgaacttctaatgaacaatcaagagaaaaattatcatactgcttttttagatgctcaattttcaacatgtttcaaccctccaatatcaattcaaacaaactttttatctcttcatcactaatcccgcaacgtcgcccttttagaattgcttgttccaagtcttgttccagctcctttttttgctcttccaataaaagctctgtattggtagcagctacataagttcctttcccgtgaaccgttactgtaaaaccttcagattctaacgtatcataggcttttttgaccgttaaagcactgatctttaattcttttgacagtgtgcggacagatggcaacggatcattctcattcagctccccatttcgaatatgccctttgatttgatcgacaatctgctcataaatcggcaccattaaggaagtattaataatcaatctcacattttcttcccccttctcgttgcaaacagtatataacagtacacaactgttatcaagtgttatatactgtttattaaaaaatttttgagtttttactgaacataaacaaaaaaagctaggcaaaagcctagctgagaacacgatttaatcgtgaaagatagatagttatttcatgcgtatgataattgtcccacctataacactcacaatcattatgccgaggacaagcatccaactcgccttctcatcatttgtctgtggaagttttttatcattcgttttatttgaagcgtttaaggcagcagagtgacttgattctgattgattgttctgagtccctaatatggacgaatcagttgtgtttggttctgtcgtacttggttctgtcgtacttggttctgtcgtacttggctccgttacgcttgctctgtgacacttggctctgtcgtacttgatgtttcttttttagtattggtaataatgatggtaccatcctcattggttaccgcactttcaaagtcatctggaacattgacttcttcgacagtgtaaaagaaatcttccccttggttattgtactttggtaatactacattttggccttcaactgggacttttgtgcgtgttccttgatagccctcgcctttattcgaggttaaactatctgacatttgccaactttcagcactaacggtggttgttcttttgacttggtattcgatctgatcaggaatctcagcatctggaacattgacccacttcttcataattttcaattctacgacaggtgccttgatggatggaataggaaaatcgaaatattcaccatcacttcctgttgttaatgtcgtacgtccattacacaagacccatgtttctccttgaaactcagcggattctgtatttattcgaacctgataagttagggtaagtttttcattttcacctaacgcgatgttgctgatagagatggtttgattagcttcagttacttgaactgctgcaacaatttcaggagcttggatccatgctccttgatcatttttgcgccacccgaccaattgataatggctattatcaaacgtaccggctccttgtaaaaggattccttcccccatagggtctgtgatcgttccattgggaatcgttttatcaatgtggttcgcaatttctttcaatgctgaaccaagaccgctaaggttttcgtccgtcgtcaaataattagccggtgcagtagcaagattacgggcaatgtattcaccccttgccgaaggtgccgttgccactgaataaaccgtaaagttcgattccttgatgtcaacgatcgttcctaatgtttcatcagtcaccacttgactgctgactggaactgctaaactatctgttgaagtcttacttgttgtatggtattgaggattagctgtttggaaagctttggtatagctgctagtatgataaccattataatcattgatctttcctgtattgggatacacagttgcattttcagcaggtaaatagctgcgattggcactatcatcgccaatatggataaacttcttttcagcttcaggtcgactttgttcaagaagcagacgttgtccctccatcaagcctttttgcataaatgttcctgagtgtgattccgccgtatgctgtaaaaaattttgcagataatcgatattggttaccttggacgtatcaaaattttctatggccaattctttaagtgaactcgtgccattaaacatggctgtcatgtcaattaccgaggatgtatcccattgattcaagtcaagactttccaaggagcttgcattcccaaacatccagttcatatgagtaactgaagacgtatcaaatttattcgcaccttcgattgcccttaaatttgatgcccccataaataattgtcctgaatttgctggtaggacaaccgtttctttaacaacaataaattcagtagccattgatggaagtttccaaggtgctgcatccacaagcccagcaacccctccataaagcgtaattgtttttgaaacttcatcatagtcccatggaacagttccccagagagaaagctgacgctgataaacgaacacaactgtctgtcccgtatccgagaacgttcctgatacattatcgggtaccgtaattaattcccagccttcgattgttttagcttctgcggtataagtgtctccgtaataaccagtcaatgtcgcactctccgcaacgtcatttccagattcatcaacatatttcacaagaacttctccggctggaattcgcttataagtaaaaacgacggtctggtcaactccagtaaacgtaccagccgcattttgaggagttgtcattagttcccagcccgatatattcttggcttctgcggtataagattctccttgatagccattcagaagcacggtattcgcaatctcatttccagattcatcgacatgcctaactgtcactattcctccaggaatccgttcatatattgcttgaatgactgcttcaccagctccttgtaccgtgatcaaggaagattctgcataaacatcattgacagaaaccccaatgctgctactaatctcccacttgacaaaccgccaattaacattgggtcttgccattatacctgggatcgatcccgtaggtgttggactcacaaattgttgaggatttcctccttctggcggattagcaattaactggactaagggattatttcgctctagaggatgattcattacttgttctgattcttgcctatttgattcgacggtattattggattgagagatctcctctgcataaaccatatctatgggaatatgcgataaaagaatggagaagacaactagaaatttaatcagttgatccattttttttactttttccatcattccctccttttgtataaactagcgaatttaaccatgcgtttcctactctacataagcaataactgcgtttttaaactcgtttaacattcgaccgtttgttattgtctattttttagacacattcctccttccaccttttaaaatcaaaaatcttcgtttttaataagcaaataaaaaaacagacaaatgactttgtataaagacaaaaatcctttgtctctagacagcgcagatgaagtgtgtcccccataagtaagcgtctcaaaaacgaaggcttttgagacaaaagattgagaaatttaaatttctcgagattaatcataacaactcaaaaaaaataaaacccaccaatattttctttacctagtgaaaaaattgacgtgatgttccccttcttcagcagaaaacattttcttcctcaggggattacataacaaacgaaccgatatatttaaaaacagcaatgtgacagggattgtttttttagaatgttttatttccgtaaatagcaaaaaaaacttaacgaccgccatttttttcttgtccttactcaacgccctgctctcttctagacaaacaaattcagcaattattgttttggtttatctgctatcttcaaagaaaaaaactgagtggggaaaaataggatgtttgaaaacgaattttcatttagtcagacaaaataattcgttattttacgttatatacttcatgtacaaaaaaaggtattctttcactaagaaaaattttcaactggaggaatatagatgtcaggaatggtttatggttatgcgcgagtctctacaagacagcaagatctttcacgtcaattggatttacttgagaaatataactgccataatatttatacagaaaagattagtggtacgcaggccaatcggccagagttgatcaaattaaaaaagcgcgtgaagcaacaggatcaaatcatcatcgaaagcttttcccgtcttggccgcagtaccaaagacttaattgatttggtatatttttttgaacaaaaaggtgtgaaagtaatcagtgtcaaagaaaattttgatactcagacaccgcacgggaaattgatgatgaccgttttccaagcatttagtcagtttgaacgtgatattattgtcgaacgtaccaaagaagggctgatttctgcacgggcaagaggaaacattggtggtagacccaaggtagatcctcagttaatccaaaaagctctccttttgtatcaagagtagggctattcagtagcagaagtttgtcaaaagaccggtgtcaagaaagcaacgttttatcgttatttaaaacaatcagcattgcaaggctgatcacttggctttccttcgctaacccagcaaaccacatcaaaaaacgaccattgttttacgatgaaagcaagctcatcacgagtaatccaatggtcttttttctaattttaacacagcaaattttctagtgtttaatcaaatattctctggttcttcttgtttctgatgatattttttttcgaaatcagtccatgatcggctaaattgatgattcgaaaaggcactctttaagccggagctttgtttgaaacgaaagacttcttctgcctccattcccaattctttggcaatccgatcatctgtccatccgcttgctactaattgttgaacgattttgctcatcttctcgataccatgagtgcctcgagctcgattatgtctaacagtggaagccatacggtgttccaatggcttatcgataacagtcactggcacttcttttaggttcaaccgttctttggccacttgatagcggtgaaagccgtcaatcagtaagtacccttctttttcgttgtcaaaataacagactaatggttgtgtgaatccgtcttcccgaatcgacaactccaaaagttccaactcgggttccgctactttattgggattgtagtgattggcgtgaatttgaatcaatggaaccatttttacagctagcacaggaaaagcaattttttccattaaacagaacactcccttttgagaaaataatagttcttcgtttggcgaaaaacggtgaacccttttgtctggaacaacgccacttcgttagggtgactcgttgtgactgtgatttcttgatccggatgtttttttcggatgtcatgcagcatttttcttaacaaaagagtttttctgcctgaagcaggctctttttcatagaattcgccaatctcgatgcgagctgtttttttttcatagtaagagaagcccatcacctgattcagcgaatccacgatcacataccaatggcaatccccagaattaacgagatagggaaattgcttttggtagattcgctcagcaaagaaaggccccatcaattgatagaaatgtcctttcttatatggtggaaaaaagacgatcagttgttctttcaactactccacatcctttcagcaaataactgattacggctgattcttggtcaattgttcataggtctttcctaacttcttcaattggtattttggcaggtgttcgatgcctaatgccgcaccaaattccacggctaacgcatagagttcagactcgtctttcttggtcaatgcgtattgtctggtactcaaagaaaaatcatttttttccaatgctttcgcgatccccttccagtcatgccaaagtacttcattcttcagccattctttgcgtttggtttcatcggggatcgcctctacatgaacaccgtacttgtcccgatagtgagcgatcagaatcgatattttacggtagtaatggtcttgcagatttttggaatataacccaatcgattccagcaaaaagacagcgtactcctgccaagtcatgtgggcaggtttttgggtattgtaatgagccaacaaagaagtccgtgcatacaagcggccaaaattcgcgccagaaacacggttgacgactttctcccaagtatccggttcgactaacgcatattgagaaagtccttttcgttgctgcaggccatatggctgacaaatccgcatttgggagagggacactccataagtgtaaagcttgtcataaaaaccattcatttcccaatcaaagtgcgcatacgccccccagacgtcctctgtcttccagtcataaagcggataaaagttgagaatctccccttgattggtttgatgcttgatccagcaatgtccttgataattgaaattccgatttaaaatagcccggtagcgatgcaagctttcttgggtacgaatgccgatgccgtaggcaaccggctcgcctttatgatgattcgcataccaaaaggcaaaatttttcagaaatttatctgggtttaaattcgcactttggtacagttccatcattgattcatcgagatctgacagcgaaatcgcatccctgggcatttcttggacccacttatcccgttcgacttcatcccacattttccactgaggttgaaaaatactagtcgtgttatcttcataaaatggcaagcagaaatgatagacctgttgaacgcttttcagccgtttgatcgattccataaagttccgagttgaacgataattggcttcgatgtctaaaatcaacaagtcaaattttttccacttttttgggcaatttggtcagctaattggaccattgctccgctgtctttcccaccgctaaaagagaaataaacatgagaaaaggtattgaatatatacgtcagacgttcctcagcagctgccaacacattgatatcgtaatatttcttcataaaccccgcttcttttacttatttttgattgaatttgtgcatgtattcactttcattataaagtgaattggggttgcttacaagcctacctcttaattgcagaatccttcttaacgaaataaacatccaaatatttccactctttctttcgattaggaaaaaaatttgtctgtctaaccctgacattgcttgagctggatcatcaattaagcggattgggaaaatccaatggttatcaaaacgtaaaaatcccactggactagttgctagtctagtgggattttccttactccaatggaaaatcatcgttcgtttttattgtttcgtcactttctccagttgagtggttttttttccacaagatgtacacaacgatgacagcaaccattaagataccgcaattcaaccatttggcatcatttaatacgtgtaaatctggagatgacaatggatcgtttcccgatagctgtaacaagatattcatcgggcgatcaaagagagttgtcataatcagtagaaaagccatcatgacgaattgatgcgtgacactccccttattttgagtggtaaatttggcgatcattcgctgatcaacaggcaaagaaggttcctgcgcataccgttgattcaaccagctgctggtcaaagattgccaaaagcttaataaaaacaaaccaagaacaaaactttgtggaaaaagaagcacaaacaatgaaagagccaaaccaccaagcagaactggaactgtatttggaaaaatcccttgcagaatacgtttgcctaagatcatggacaaaatcattcctccaagataaggcaaatacaaatagcgagtcaacgcctctgtcccatgtagacttcctagataaagcgctccaaataagaaaacaaaattccctaacatgccatttaaaaaagttagcacgttgagccatgagggcagcttccaatgcttcttcgctcgtcccagataaaatacggcacctaagaagaggaaaaagaaaccataaatcgcccaatcaagcaattggatatttgccaataaacgtgcattccgcagcaaaaagagtaacaagaaaaagattagaaaaagaagcaattctttaaaggcgatcacttttgaattcatttgcttaaagtcgatgctatatctaggatagtgggtaactgtatggtaagccatgacgtaaaacatcgtatacaagccaaatgcggctatcagcttcgttgtgcctgaccattccatcaccactaacaacaaaatcagtaagaacaatgcaaaaggcacttttttacgagtcatattgataaatcccaagttcttttcatgaagattgaccgtgcgattcgttggaactagccaagaggcactcagccctagcagactaccggataaatagaaaaatggaaaataataaacacctagaactccagcaaaggctccaacaccacccatcagcaaagcatcaatcagcagtgtataactgtctaatcccaaacgtatactgcggatgagaaaaattcctgtcatccgtaatgtataaaataaagtaaacggcaaaatcgttaaccaactcttgccatcattcaatcctaggaataacaaatacggaatcacgattaccgtattacttaaaagaaatggggtcgtttgtgcaaacgtcacgagccatttcttgattcgttgaaccatcaggaacctccttatttctctctaccaatcactcatctgtggtacgatctattgacatgtacaagtgatcgtttctcatttattataccttttctatataaagaccgcacggctttccataaaaaaagaagctaagagtcgaaggcgttattcctttatcgctcgtttagaatgtcgtttttatcacttacatcttttcttccattgaattcaatcattcgctatgctacactagcgttacttttgtttggctgacgaaccgctgccccaaccatgttcgtttggaccaactcgttgcgagtattcgtgttttcggatgctctttttgtcgcgttttttgccaaaaaagaaagtgagtgaatccaaatgatccaagtgcaacacctcaacaaaagcttcaaagtcgcgaaacgccaaagtggttttcgtaatgctaccaaagcgctctttcatcgagaggtttcaacgatccccgctttacaagatatcagctttacgattcaagaaggagaaatggtcggatacatcggtccgaacggtgccgggaaaagtaccaccatcaaaatcatgtgcggcgttttgacacctgatgacggaacgtgcttgatcaacgggcgcgttccatggaaagaacggatcgatcatgtccgagacattggcgttgtctttggtcaacgcagtcagctctggtgggatgtcccagtcatcgacagtttcgagctgattcgtgatatttatcgggtcgatccgcaagtctatcggcaaaatctggaagagctagtcactttgctcgatctaagcgaaacgttgaaaacccccgcccgttccttgagtctagggcaacgtatgcgctgcgagattgccgcttcgttgctccatgatcccaagattttgtttctagatgaaccgacgattggccttgatgcggtgtctaagatcgcagtgcgccaattcatcaaaaagcgtaatcaggaaaagggaacgactgtcatcctaacgacccatgacatgcaggacattgaagcattgacagaacgcattttactgattggtaaagggcaaattttattagatggtcaattgccagagttgaagcaacgcttctctgacgccaaaacattgcagatcgattatctaggaatcgcaccgacacttccagcaggcgtcactgtaacccaagcagaaatcgggcgattggaactaacgattgatccaaatcagctgaccgttccgcaagctatcacacagcttagccagcaagtggagatcactgatctgtctgtttccagtatcacagcagaagaaatggttgctaagttgtataaggagtaccatatatgaacaagtatcaggcactttttcgcatccgttttacaaatagtctgcaatatcgatcggcagcattcgctggaatggtgacacaattcgtttggggcatgttggagattttcgctttccgcgccttttatcagaccgatccagctgcttttccaatgacctttcagcaaaccgtctcttatgtctggatgcagcaagctttcttagcattgttcatgttatggttttttgaaaatgagatttttgatgccataacatcaggaacgatcgcttacgagttggctcgtccaatggatctctatgaccgctggttttgccaatcagcagcgaaccgctgtgcaaaagctttgctgcgctgcctgccgatttttgctatcgtctttttgttgccagtgccctatcgtttggtcttacccgaaaatctaatggtcttactgttgtttatgctctcgcttcttttaagtctgggtgtggtggtggctgtgtcgatgttgatttatatctcgactttctataccctttcttctctcggggtgcgggtcgtgatgggggcaatcggtgaatttctcgctggcgccattattccgttgccatttttcccacagccttttcgacaaatcgctgaattgctgccttttgccgcgatgcaaaatgtcccgttacggatttatagcggggatttggttggacatgcgttgtggcagatgctgggaatgcagctcttttggttggtggtattggtagctggtggcaagttttggatggctcgtgcgttaaaacgagtgattgtacaggggggttgaagatgtctctttactggaaatattttagtatccatttgaaaagtcaaatgcaatataaggtttcgttcttcttgacggcattaggccaattccttggttcctttaccgcttttctgggaattttgtttatgttttcccagttccatcaagtggatggcttctcatttgaggaagtgctgctgtgctttgcgacagtccttttttctttttcattagcggaatgttttgcccgcggtttcgacctattcccgcaaatgatcgccaatggcgaatttgatcgagcattagtccggcctcgtccgctagtctttcaagtgctggctgctaaaatggaattcactcgcattggtcggctcctgcaagcattgctcttgttttgctatgtactgccaacaagcggcattgattggcagccaatcaaagtgctgactctgactttgatgattctctgtggtgccgtcttgttcttttttctctttttgatttatgccgccatttcttttttcacccttcagggattggaattcatgaacattttcacggacggcgcccgcgaatttggccgttatccatttagcatctacggcaaacaagtcttgcggatcttgacctatgtcattccaatggcttggtttcaatactatccctttttatttatcattggttggctggagcagccactgtgggcgttcgctccattactatgcttgccatttggtattcccgccctcttgttttggcgctttggtctgagcaagtatgtttctaccggttcgtaatgaaaaaggaagtcctcagtcggggcttccttttttcgtaagtctgcggatatttcttttaaaacgataggacaaaaaagccgagcgagtgtacaagtcgatcccaattgccagccaaacaccagcgatccctaaattcaagctattgcctaacactatcacacctactattcgtatcacccacatcccaaacgctgtactatacaatggtgtcttggtgtctcccattccttgcagcacgccagctagaatgagactgatcgctaatcctggttgattgaacgcatcgatcctcaaagccaccacgatttgacgaagtgcttcgggatctttcgtgaacaaagtagcaacaatcggagacccaataaatagtccaatccctaagagactaagaataatcacaccatattttacagataaaaaagcaattcgttttgtctcatcataatctttctttcctatactcattcccgtcagtgtagcagcagccgtcgccaacccataggcaggcatatacacaaagctttcaatactgccagcaatggtgtgtgctgaataggttttggcaccaatcgccacgatcagaccaaagtacaatacctgtcccaaacgcatcactaaccgctccaacgctgctggaaaagaaattcgcaacagttcattgaaactacttttattcaatcgagtaaacaatggaaaagcaataacagaatgctgtacttttcgataaagtaatatcgtacctaacgacctggcaattaatgttcctaacgctgttcccatcacacctaaagctggaattggccctacaccaaaaatcaagacataatccactacgacattcaatacgttcgtaataataccgattttcattggtgttttggtatctccgattgctcgtagcatacttcctaaagtagacatcgttgcaataacaatagctccgccccctacaatactaaaaaattgcagggaagaatcaagggtttcttttgtcgctcccatgatcgttaaaagctgagatccagctactaaacttacaattccaagaaaaagaccagagatgattgccaacaacaacgattgcttagcgatctgctttgctttttctaggttatttgcgccgatacttcgtgaaatcaatgaagatgtcccaattcctaaagcaatgaaaatagctatatatacattcaatattgcattagccaaaccaacacctgcaacagcaaataatccgattttagaaaccatcaatgagtcaataaagcccactgtcgtttccaagacattctccacagttgctggcaatgccaaatgaatgattcgtttctggatttgcatgtcttttggcaaatctgcatttaatttagtcatattctgtcactcaattcaacttgttgtattgggtgatcacccgtttcaaggccttcatttcttcctccaaatccgatccttcactaacatgcatcaatgcatgatccgcttgggcctccaagaggatttggctgattttttgaatggccgaacgagctgagttcaactggatcatgatatccccataatctttattagcgacgaccatctttttaatcccagagacttgcccttcaattttattcaggcgtttaagtaattcatctgtttgatgttctttggcatgtgacatgtcgactcctcctttaatataggggtaccccccacccctatattaatcaaaaattatttccaagtcaaaaagttttgtttaaatccttctattgctaaagtcatttcaattatctttcctcggaggtgctacaaatccgctcatgaatgagagaaacagacagcaacaaactcacttagtgcaacttttacaagtactgtcgttctatatagtaattttacactttgaatattgttttaaacactatactgtgagaaaatcaaagaagaaagatcaacttaaaaggagcgaatcaacatgcagccatctgaaaagccaacaacccataaaacgcgcaagccaaaacgtcttgttctcatcctcctccctaccctggttgttgtagtgttgggtctgttcttgaatcacttcaattactggccttttcagggtagcaaaatagccggtgtccctgatggtcagcttgttcaactagaaaataaaccagatttaacgggtttgctactggcatatggttcgcaactaaaattcaacaccacggcaacctcattaacagtctattttgatcactatcgcaaaggtgaattaaatactcatgactcagttgcttctttgacttatgaacaagatgtttccatcagtggctatctaaactttggtattgcggaaggacagaatcatttattggtgaagctattctccaatggcgccatgtcacaaacagtcaccgatctttccgactatgactttccccttacacaggaagacagacaatttggtgctgtgactactatcaaaaacggcaaagtgaaacttgagaaaaacaaaaaaatcccgctgctttatttagcagaaggaaatgatggactaaagatctatgatgatatggcgaataatctagcaccagataacttgaaaaccttgccaaatgcctatttgatttacctggaaattaaataacataagtccttataattatctaaattgaagcagctttctattttctatgaggagatatttttttgcaccaacaaattgtgaacaaaaagagtgctatttcttaattcgttttcctttacttttttatgctttttacttattattcttttgaaataagaataaattaaaataaaaaaggagagcaaacatggaaaaatatcaagtgtttcctggtcaagactatcaggcaaaggttattggctttagtggtttacaagatgttagcgttattcatgtttacgaaaatacagctacagtgttgattcaaggtacttctgaaacaggagttgcgaaactttgcaacttttcaatcaaaactgcatcattggtgggataaaactttcagagactgaggaaactgattttaggtacaggatccccaagacagaaaaaaggcagcccaattagtgttgcttcgttgaaacaccaaaatgtataaagtatttttattttatttattcaatatctctctacattatttgcaaataatgttaaaataaaaaaacaggagatgtatcaggcttcccccaagagaatcttccccaagtgctcttgcctggtacttcttccttgtttatttttcggaactacagaacaatggtaagccattcttctacgaatttcaagtggtcttattgctgagcaaaacaaagatttactattctatttccctcaaatctcccaataaaaaaacatttcttctacttttgttgataaatttccagctacggggatctgctgataatcctatcctcgaataaaaaaactgcgaaggcacttcttgttgaagcgtcccccacagtcgttatctatgacacatttctcattttgatttgaatccttctagtttggaatagtctctgtatatacagtcttctttccatacaattcctgtgtgattcctgaaagataatcggcagagttggtgctgcgaagattatacattaggaaaatcccgtaattttcagccttcgtccgtttagcatattgaatgctttgtgcttggtttcttcctacttctacagccgctggtcctaaacggtcggcccccattccaacaaagtaaggaacctgccaagagccataatatggattccagctataatcgatcgtctttgaaacattttcattatacattgaattctcggcagcgggaccaatattatatagtgtgatcagcttatctgtcccaagacgatttctcaatgcttgaataagccaaatgaatgactgatcatttggttgaggtgtcccattcttcccgtattctgcatactcatcatcaaaatcgattccatctaaaccatacgttttcaccacttgttctagctccgcagcaaacgcatcagcactggcataatctgtgaaatttgcaaaaccagctccttggtgatttcctaatatcgataagagaacttttgtgcctcgtgcttgtaacggtttaatctgggtttccttttcggctagtgttttttgtacttgctcatttaaatgaagataggcttgctttgtcgctggatcataattgatattcgcagcaaaaatgatcccgatgtcgattgcaggtttgtccgttccggctagcgtatatttcccaatgtttctaaattcgttgtcattgacttcaacatacatcactgttttcggtgtgacttgatcggcagcctgagcttctaaaaccggtgcggccaaagaaaagagacttaaaagaaccatcaccacaaaagcaactgtgaatcttcgagatggtttcactgctagttgattcttattgttcactgtcaacgcctcctataataatcagatatttacacatcatttatgaagagtttttttgcatagagtctattgttctgctgccataagcgcagcttctttcaatgggtcatattcagggctgaccgcttcttcatacttagcagccaaaaacactcgattcacttcataatgagaagtggcacgttcgatttgttgacttaattcttgaacttggcgatcggaaaactggtcgttctttctagcaagataatgtttagcaaaagcttgcgactccgccaaagagcagccttttgattccaaaatcgccgtttttgtccagagaaagtccgtcttcaacaactgatcgtttcttccttggataccatcgcggccaatcgcataaagaaacatgcctccagtttcagttgtacggacataatttgcgacactatagagattgctggactcataaggttcacgggtatctccccatgtttgattggtacgttcttcaggaaacgagagaccgactaaatactgagaccgttcgatacctgtctttgagaacgtgttgttccaagaagactccgcccgcgtggcattcgatccatattgctgcgcacccaaaatactgaacgctgatgaaacaggagtaaatggctctagggaaaagatatctacagtatcataaatcagcagtgtatctgtgtctgacttcggtccaatatagtgtgagagggcctcgatcaccccatgggcgattttcagttgactggtagtataagtactttccatatcaaaatcaaggccatcgattcctggtgtcatatatttatctaaaagctgctttgcataatcgtcaaattcttttgctgttggttggctctgcgttgtaggaactttcaatagttcgcgataatctaatcctcgtacaagctttgttcctcgcttgtgtaattctggtccataaacattggcgacttcatcaaaaaagactttactatctgcatcactcacatttgcgtggaacacattgaccacatcaataccataaggaatatctgtcattcggatctgattattttgttcagatggaatactttgatctctccatgtgcggtaatagaccataaatgttttttccgatttatcaacagtcgtggcagatccctcaaccccaaacaaaaacccacaaagcaacaacgaactagcggcaaacaatcccaaaacgacttttttcatcaacatccatcctttcagaataaaatttgatacactttatgttagcgcttacttaatgaaatatctaagaacaaattataggtatttcataacaaattaaagatttttctttaaagtaaaaaaagaatgcactaaaaaatagcaacaaaagaagccctctattctcatgagggctttcttatccttttcttgcgaaacggcagtctcctaaaaaagaatggtgattttgataacacatttttagagcattgcttagctgcgaacaagcaattcaaacggtaaaacgatttgttccctactccgttcctggaatagacggaacgcttctcgtccacagaggtgcaaatggaattcaacggttgaaaagttcagtaatcgactgatcagtaagttttcttgaccgataatcagaggtgcttttctttccccatattgagataatattgtcgctgcgatttcatctccattggtaatgatcccgtcaacgccccggtctttgaaaaaaacagccgcagcctcgccatcttctgctttgatacaatcccaaaaaatgtcctcttctgaaaacccgggaaagagctcctttgctttagcgatcgtattgatcgaattacagctgagtcgtttactgcggccaagagtcaagcctaaccgtttaacgccttgttctttaagataaaggatgctggctgtcactgagccaacttgatcgatcgttacaaatgggacatccgttccgctggcatcttcacaaaaaacgataggaccattttcaagataggggcgaaatgtctcaatatggttggcacgagtgatgacaatcaatccatcgaaccctttggcagcgaactcttctaaatagtccttctccaaggctttatcgaaattagttggtaaaagcgtcaccttatattgttgcgcaaatgcttcttccataatgccatttagtattctatcgaagaagggatggttgacaaatggtacgatgactcccacattgaatgtttttcctgagcttagtttctgagcgatcttattcggcttatagttcagttctttcatcatggctaaaatggtttgacgcttttgttcttccacatacggatggccgttgataacccgggaaaccgtagtgatggaataaccagtcattcttgcaatatctcgaatcgttgccataaacagttgctccttatgctatgtattttcactgctgctttatcttcctctgtctagttgtagtctaccataaaaggaatataaagacagattgtggggatgaaaaggaagatttctctaccataagtgatagacaaacaacccgaagtagttctttctacttcgggttgttgattattcttcttcattcctatctcattttttctacaaaggcttttatagaaggattttggcagccagcgtcaaaacattccaaaaaacgtggggttaacgcggtgcgaaccaaagctggatccagtgctttcaaacctgacagtagtggttttgccatcacttgttttacttcattcaatatttctgcattgcgattttgtgatgctttccgttctttaggatacccatttcctttgttagaaccaaaagcacggtcgaagattgtttccaggtttagctctgcgccccagccgaatcctttagcataaggcaaagacagggcattaccattattgatttgcaaaaaaagatatgcgtcggttggttcgatacaatacccgcatatcacaccgggataggcatttagagacattaatgcgccttgtccagtgccgcagccagtcacaataaaatcaatcgctcctgaatgaagcagcagtgccgcttgaatacctaaatgaatataagtcaaacgtggattgtctttgctgtaagcttctggcagatcttctgataataaaggttcactcatgccaacattataaacctcatgaccatatttgttgccgattgttgtcaattcatttaggataattggattctttgctgcctgactaaattcgttcaaaagtgcgattttcattcttttccacctcatttatttttaaaaaaagataattgaaagctgccaaagcgttttttttcgttataaaagcggccattagtgagtcgttttctgtgaaatcggttaattcccgataaaaatgtttgttctgtctaatttcaatcggggtctgcattctagtggccagtaaaaagaccgtgtccaccatttcatcctcgtaccaaagaatgggttctttcaaaaccattattgctactttaggttcaaatacttctgtcatacttccatgtggaatcgctgtatgatgaccgatacaggtagttgtcttttgttcccttttccaaaccgtcagatagaaatttggcgatacaaaccctaaactttctagttgattggataaaaatgtcacgacttcttctttgtttgtatatgtttgatttacgaagatcaatcttggatccagcaacggcttggatgcatcggaaaaaatagagattgatccaggtacaattccccaacgagaaagagccgttcgaatattcacaagatctttgtttgaaggaagataagaaatcggaactgcagtgaccgaatctactggaaccatcgttaaataaaggacatcttttctggtagagtcaatttcttcttctcgtataatatgaatctctttgatttctggaatattttttttaatatattcagtggcaaacaaactttgggaacggcctcgatccgttactaaataagcatcaacttgactttgatttctcaatatagcggcttcgatatacaaaacgatgtaagcagtctcatcttcggttaactgtacattatagtagtcctcaaataattgacttgttgaccaaacactcaaaaagacgcgaccatagagttttttcaagtctcgggtcaattcagatgaatttttgtgcccgtatttcattcgaaaaatagcagaacgaagatggtttgtcagttcttcttccaaaattttgtcttccgtcaatggctgttgcaaaatttctgaaatagatgaaatgattgtatgaacaaattcaagcaaatcgttatcatactgattttttaaattagtgagtgctgccgaatccttccagcgcaatttatttgatacaagaatttccgcagtaagtattcttttatctacctcattgaatgttccgaatcctcttttttctaatccacgataaagggtttcaacaaaactatattcattggtgtattctctttcaaaatcatcaatcgttggcatatcagaggcataagaaaatcttccaatgctcaaaatcagcatgattcgtattttgataaacgaggtattagaaaatttgattttccaatcactttctgcttttcgaataatctcagagatttcttcaacagatattcctctggcaaatcgttgcaaaacaacagtttgtttttcatcttcttgcagaaggatcgcatctcgaatcgctacccgttttgaatattcatcacctaccaaagtaagtccttttccgggaatcgtttgaatcataatatgatgatcagcaaaccattctttcacatgactcattagttttctgaaagtaggtatactgacatataatttttcagctaattctacttgagtgataaagtgattactcgccctttccaacagcaaacaaattaatgtccattcatcattttgggaaattccttcaggtatagaaaaatcactgaaatgttttaataactggttttgtttatttggatagagcacaaataagatccctctaccaggcttcgtatcaattcgtccaagtttattttctaccaacaaatcatcgatttgggcgattttcctccgaatcgatttttcagatttgccaacatattcagctatttttttgatagaggtctccggatttttctgaagaaaacgtaagatctctctctttactaatttgtcttttatcaaatccaaagccctcctatcagattctgcctttcatcaactattcatgacccgtgtaagtaacctcgccaaaaatataacgatcctttgagccgattacctcaatgtaatctttcacaaattgcttgactcctgcttcagcagccatacataaatgcatataatccgtttgctcgtctttttttagttctctcatcatggcttcttttgcaacagtgaacgcatctgtagccacattgattttattgattcctaaagaaactgcttttcttaaattggctttcccgcaaccacttcctccatgaagcactaatggcatctgcaacgtttcttttaactctgctaaacgctcaaagtctagttgtggtatttttcctttggggtagttgccatgtgcggtaccaatcgcaacagctagagcatcaacatctgttttttgaacaaagtgtaacgcttgttcaggatttgtgtaaagatccatatttgcatcatcttcgttcagcgcttgtcctacatgtcctaattctgcttcaacagaacagccaacgctatgtgcaagactgcagaccattgccgtcttttgcaagttttcttcataagacagacttgaaccgtcaaacatgacatttgtaaagccttgattgatacattcagcaatgacttggaagtccatgccgtgatctagattcaacgcaacaggaatagtaactctggctgccagttccttgatcaatggaatcatttcttctttatgtgcatgatttttcatttgaccaggaccgaattgaatgatgatcggtgaacgctgttctgcggctgcttcgattcctgcacgcgccatttcaatattgatactattcatcgccatcacaccataataatttttattggcatcttctaaaattgatttcatacttactaacattgttgtccccctcttcttcatatgatcgcgtttcttattcttctaaagtaatgtcaaaatcgaaatcgtctgtttcactgttttctactgtttcagtttctgctaccgtttcacgtttgatgaccgcatagacaacgccggtaacaactgaaccgatcaccagagctacaacgaacattaatggattcgtcatcattggtatcacaaaaataccgccatgagccgcaactgattccacgccagatcctaccgctattgctccagcagttgcggatcctaatacggagctgatgatgaaacgaactggatctgctgccgcaaatggcagtacaccttcggttataaaacataaccccattggaaaagcagctttagcggtatcgatttgtgcttgtgcaaatttttttttggctaacaaagtggcaatgaatgccccgattggcggtgtcatccctccaactagtttagccgccattggaccgttgattccatctgctcctaatgcattggctgccagtgaagcagttttattgataggcccgcctaaatcaaatcccatgcaggcaccgattaccccaccgatcacagactttgctccgccattcagcgcaatgatccattgttggaatctatccataatgaaagctaacggtggcgagaaaatcattagaaacaacatcccactaactaaagtaactattactgggataaccaagaccggcatcaagccttgcatccaacttgggactttccattttttcacccaattcacaccataaccaatcacaaaagcgaccagcaagccccctaaaaatccggcttttgtttcattagcggtatatcctaaaataagtgctggtacaatagctggccgtccagcaatggaataggcggtgccagcagccataaccgcaaccgcaaaggccattgcataggaactcagcttgttgactccccaccaaaaacctgtccacgtataaggatccatctcagaaaacggcgtgactcccggttgaactaaatctccaatattgtatccgccaaacccttttgctagtgcccccaaaataccaccggctacaatgatcggaatcatatacgaaattcctgtcagtacgtgtttctttacctcaaatttccccttcatgtatgctactcctttccttgatcataagcctaatttttcatgaattttcttgattacaccttctggtgatttcatgatcaatgctatgggaatgtcaatgacttttttccctttgaatcgttcccgagatacgccaatatccgtagctagcaacacgatatctgcttcacgaatatctttttcagttaattcattttctaccccaatcgaaccttgcgtctcaattttcacatcatccccagcttttatggcagctttctcaattttttcctttgcaatatacgtatgcgcgattcctgctgtacaagcagtgattccaactattttcattttcttcctccttaaatctttaatcgatcgataacctcatcaactgagtgggttatttttaatcggtttaatagttcatcatcacttaattttgctgcaaccttactcaacaattgcaggtgtaattttgcaccagatacatcgtccggaaccgcaaacaaaaagaaaaaattaactggttgattatcgtaagattcccagtggatcattttgtttgttttaccgattgcgattccagctcgcatgaccgaatctgatttcccatggggaattgccacgttattccccattcctgtgatcccttctgcctcacgctcgtatacagaggcaataaaatcgtcaagtttgctgagataattttctttgtacaatagagtagctaattcacgaatcacttcgtcttttgtgctggctttcatatttagatcaataacattccgatcaaatattgtttgattttcattgactgtttccattctttcgctccttccatctcttattacacaaagaataacagaaaaaaaagaaagcgcttttaaagaaattgggaagagcattgtggaatttttttctttgctgttcaatcatgactttcagataataagacctgggcatttataagtaaaaaaatttatagataaaaataaaagcccaaaattttttgggcttttcgggttagtagatttctaatattataaaattaattattgatggagaagaacataagccaaggaaataagtaccctaagtataatagtataattctaagccttatttgctctttccttaaacacatacatccagcccgttaggctaatcactaaactggctaaaacaagccaaaacccggaatcaatggtgattctcccctctgcaactagcttctgtgaaccaatgaccatgtctcgacagtaaagaaatgttccacctgcaccgataattagggagacaatcaatgtagtataaatttcacctttactagcattgtgtccaaaaaaactgccgctcaacatttgatagcctactatcacactacctacgatccccatgagaaaaaacgcaaaatcactaggattactgaaaaaacccggcatagtaaataataatataaatccaactttcaatccccacttatagctattgcttttcaactgattctgccgttcatcataagactctttttccattctactcactgatcgaagaagtaatccatagaagagataaaagccaagaataaataagactccaataaaccaatagcctacccaggtaaagaaaatcaaatttgctgctacccacagcacgtgtaatactttctcaaaaatacttgcccacttgtttttcattcgtttgtgcctccagtcaatttaaacagctcctccactgataatttaaaataatgagcaatccgtaatgccaactctaatgaaggattgtatttgtgggtttcgatggcgttgatcgtttgacgagaaacgcccataatcgctgctaattcgccttgtgataatccttgttcctcacgtatgcttcttaaacgattgatgactggcatcttctcactcctgtcaagtttcctttacatagaagttaccatatttcacagcttgtgtaaagattcctttacatttccgattttcgataaaatccaatctatcctccaaatacaaacttattccttcaaatgttagatatagcccctcattagtaacaaaataacttatcattctattttgacaatataatctgttaaaatgaatgaatcccacctataaaaaattgattggagtgtacgagatgaagaaagtattaatcgctcttttttccgtcggtgcaattttaggactgtcgatccatttctttggactacagatcggactcgcactttttaataaaccgatctatatgattccaccttccgtctatcgattaacaaaagatgcattaacaattatggagaattatggagtatatgcaaaagagacaggatttgagaaagaaataccaaactatctagctcaagtcaaaaaagacgatacgtttgatgatgttgtgcccatgctcaatgaagccataaaggaagctggtggtgatcattcagctattattgaagtccaagaggataaagcgccacttttcaatccagctctgcttactttccctagaatcttggcagaagacaacattgtgaccctcattttgccttcatttcctgctagtgatgaagaaaatgtgcacacttacgttactacagcactcgaacaactttccaagatttctgatcccaaaggtgtcattattgatctacgagggaataccggtggcaatatgatgcctatgttaggggcatgcgctcctttctttaaagaaggtaaactattcgaatttacttctcctaacaaaaaaatccccgtcttcaagaaagacgggaaaatatgttttgaagaagataatttaagtctaccaactaacttaaactttcatcacttgcctattgctgtcttaacagatcatcagactgctagttcagctgaagttgtactggttgctcttttaggacaagaccatgtttcctcttttggagaagaaacagctggttatgccacaggggtttcaatgattcctctttatggaaaatacgctttgtccttagcaggtgcaaaaatcaaaggttccaatgggatactgtatgaagaaaagccaattcttcctgatgtcataactgaccacccggaagatgctgcactaaaatggcttaagtccattcattaaccagcaatttgagaaaatccttactaaaaatactttttttccttagattctgacctactctatctcagcgccttcacaagcgctgttttcaagttaggatttttgaaggacaccttttttagcatagcgccgaaaaacacgatggaccagtttgctcgctaatcgttggataaagacggaatagttgagtaatgcgatcaacaaaatcaaattgatataggtcgtattgccgagattaaatagatctcttccgacaatcaatgcgataaagtagaggagctgtgtgccgaagaagacaaatgttcggtacttgctgtttggcggataaattttccgctggatcaagatgtaattccatgcagtaaaaatcacacacatgatcgataaagcttgaccactgctgccgaacaagtgcccgatattaataataagtaatgttccaattgcgattgacagcgaagccgggaaggcatttttgaaaatagtagacaaaaaggcgcctttgatccgattgaaatccggttcgaaattcaacaaaaaggtaggaatgcctacaaaacaagcattgatgatcgtaagttggatcggttcaaaaggataagcggtccccgataacagtgttcccatagtgatcaagatggagaaaagcacttgaaccaaaacgagcgaccctgagcgggtaatattattgatgactcttctcccttcatccagtaccgaaggcagcgccgaaaactggttttccagcagaactaaatttgccacttgtcttgctgcatcgactcctgatgccattgcgatcgagcaatcggcttctttaagagctaggacatcgttgaccccatctcctgtcatagcaaccgtatgattcatttcttttaaataaatgaccatttcttttttttgctgtggagtcactctaccaaagatctgatagttgccgactacctctttcagttcttcggaggtaagcgtcgaaacatcgatataatcagacgctccgggaagattgacttttttggcgatttgactaaccgtgaccggatcatcgccagaaatgatcttgcactgaatggcttgggatctgaaatactctagagtagctttggcatctgatcggaccgtatccgataataagaaaaatcctaaaggttcaatcgttgcaggtaactcatgattttcgcaaatctgagggctatgtgccaatacaatgacccgatacccttgttcagccagcgctcgttcttgttttaaaacaggggcatgctcgttggacaaaagaatagaggccgcaccaataaagtaggtcccttttccttcaaaagaaacacaactgaattttcgttccgaagaaaaaggcacgacatgctgcatcgcatacgtttccttctctggaaagaagtctcttaatgccatggccgttgggttcttgtccggtaaatgtgccagtagattttgcgtgatctctgccatttcttcttctgaggtaaaagggatcactttctctactgtcatttgtccttctgtgatcgttcccgttttatctaagcaaagaacatccactcgtgctaacgcatcgatacagttaagctcttgcaccaagactttttttcgtgccagatagacggcactgatggttaaggtcacactcgtcagtaaaaataatccttctggaaacattcctacagctgcggcgacagttcgcaaaatggctttgttgaaagaggcatgcgtaataaaatattgtttaaggaataacaacgtacacaatggaatcagaatcatactgatccagcgaatgactttgttcagacttccttgaatcaagtatttttgccgcttgatcgttttcgcttccttattgattttttcaatataattttcttcgccgacgtggatgacttggcaaaatgcctcaccggctgtgacaaagctgcctgaaaacagttcagcatcaggttctttactgatgctatccatttctcctgtcaatagcgattcattcaattccaatgaaccttcgatgactttggcatctgccggaacttggtcaccattcttcaataacagaatgtcatctaggactaatttatggatcggcaatgtttctaaattgccatcacgatacacattgactttggcaacttttaacagcgccagtttatcaagggttcgcttcgaacggatttcttgaaacatgttaatgatcacattactaaaaacgacaaaaacgaataagccattctgataagaaccagttaatgccactaagaaaaagaggaggctgttgatcagattaaaaaaagtaaaaacatttgtaaaaatgattttcggatacgaattcgtcttatctttctttgatttgttgacttctccccgttgaatccgtgcttttacctctgctgaggttaatccatgtttgttttcgatgatgtctcaccctttcttcttatcatttgtcatactctcattccatcttacgtaagaatggctggttaatctataggacttccggttggtttttgcggaacttttattttttatagtctaaagaataatttatcctctcataaaagatgacctaattgtgtaaaatatagcataatatgctgctgcttggcgtttcatttttgtcacttcactgtcacgctttggcataatgttcctttctgacctcgtttgtttagtacttgaacattcagcaaccttgttctatcaacgatactcgtaatccctttctgctaaaataaataactagagaggtatcatcttttttgcgggttgttttttatctttagaaattctaaagggttggaatgaaagttaaaagaacacgcttcgacaaaaaaggctcaaaaactttttatcaaagtttttgagcctttaatgatttccgtttttttgatcagtaaattttcattcacaagtatcctatgacgctctgactaattcaaatgtttctgatccaaagagtcaatggcatgcatgagaccttccaacccagcaatgattttctcttttggtgcacctagattaaaccgcaggtaagtcttaccttctggtccataaacctcaccattcatgatcgcgattctttcttgttttaccagaacactttgcaattcatccatactataaggtaaatcttttatgttgatccagcctaagtaggttgcttctggaatagtgaaatgaattcgcggatcagcagacagtatcttctttgcttcgaaaaagttctcgtcgattgtttgattgagttcaacggcccatttcttttgattccgataacagtccattgtcgctagtagtgcaggatatggaatcgacgatagaccatctcttgctttcaatatcgtcaaaaatctttctcgtaatttttcatccaaaaagatagcataagagccacccagtcctggcgtgttgaacgtctttgatgcggaggatagcaaaactgcaggcacctctatcgaatcaataaattctaagataggtcgatgtttttctcctggacgccggacatccatatggatctcatcactcaagatagcgacgttatgcatttggcatagcgaaaccaagttggatagttcttgatcagtgaacactcggccagttggattgtgcggattgcatagcagaaaaattgctggtttttcgatagcaaatacgttggctaaagcatcaaaatcaaccgtaaaccgttccccatcattggttaaggaaaatgggatcaactcccgttcgttaccggcgatacaatgataaaaagcatcatagcatggagtaaatgttactactttgtctccttttcgacttaatagttggatgcaaagagataagctataaatgacacttggcgagtagacacaccagtttggatcaatcgtacaatcaaattcctgcaaaaaccaatggctgatgctctgcttataatcaagatgattccagcgagtataaccaaaaaaacctctagtcacagctttagccaatacttctttggttccatcagggatcataaaatccatatctgagattgagaagggcaatagccctttttctccgaaacgatcttggacataatcccactgggtcgaatacgtgccgtagcgagagcgctgttctttaaagttactcaagatcgatccctccttcatccaaggaacgaataaccgcagaaatcaactcgatcgtcgcttcaacgtcattgatgtccacgatggaatgccacgaatggcaatagcgaaccggcacgcaaaagactagggttggtttaccggcatctaactgaaccgaaccagcatccgttccacctccggctaacaaatcatattgccaaggaatttgattgctttcagcaacttccttgcagtaatccaacagctttatatttcctaatgcggttttatcggccagaacaagacctggacctttgccttgaatacgattaggatagtccgcagcttttggcgtatctttcccattggctacatcaataacgatattgatatcggcatctacttgctgcgcggcaactttcgatcctcgtgtcccagcctcttcttgaacagtccccacaccaatgatttcgacatgttgcgttttaatctgatttttgatctgagccatgatcgtacaggcaacacgattgtccaatgctttaccaataatcttctgctgattataacttttcttggcttgagtatttggcaaaatcatatcaccaatctgcaaaccagcagcttccaattcaagttttgatttggccccaaaatctatatacatctcactgattggtactacttccgacattgcatgcgttgattttggcagcgttcccaccacaccttctatgatagagccgtttttacgacaagttgctcgcacttgctgccccaaaatgacatgcccccaccatccaccaatcggatagaagtagacaaagccttcctctgtgatacggtggacaaaaaaaccgacttcatccatatgggcatagagtgcgatttttttcttttttgttgtcaaatctccaaaatagaggtttccaaatgaatctttgacgccattcgaatcaatgatcgtcatcagcacctcttgcacttgtgactcttgaccaggcagtgcatctaaattagaaagacgcattaataatttatcggttgcaatcaatagttatccactccttactgaatttcgtcaaaagttcagcattccccagatcatttactaatatatcgtcctcgatgcgaataccgaatttttctttcgggaaatagactcctggctcaattgtgaacgtcatattggcttgaattgacaactcatttttgggtgctacggccggatattcatgacaagaaagaccaatgccatgtcccaaattatgactaaaatgatcctcaagtccctctttcctcagtgcttgtcttgcaacttgatcaatctctcctaacgttttattgaaagaaaccttttgaacagctgatttttgagctgccaataggatctcataagtttctcggatctcgggttttacttcgccaaagcctatcgtccgtgtgatatccgaataatacccgtcgtagatcgttccaaagtcaatcatgatcagctcattcgcttcaagttttttctgactagcatgggcatgaggcaacgcggtacgctctccggaagcgacgattgtttcaaaagccgggccttcgctacctaatttcttgctacgataatcgagttcattcgctaagtctagttctgtcatccctactcgaatcattggcatgatccgttctaatgtttgatcggcaatctgcgccgcctgtctgagggcacaaatttctttagatgatttgatcattcttaaactttccaccatgtttttggtggtgattagctgaccattggcctccttcattaaaaagtgaagctcagtaaaagtctgataggaaatggtttccgcctcaaaacctaccttcattcctgcaataaatggtcgcattacttcgatcaaatgacttccaatcgggatctcacaaatttccacaccagttgtttgttgagacgcttgttctgtataacgaccgtccacaaacaaagttaatttattttcagtaactagtagtaagccgtttgaccccgtaaatccgcaaagatagcgacgattcgttttatctgtgactacaagtccggataattttttttccgctagttttgctcttaatgcatcgatcctcatctattttcccctcattccttttctaacctgaatcatctttaatagttgattctcgtctcaagggtaaacaatatactcagaatagtaaaaacggggcacaagttcacaagataagtgatgaccgatagaatggtttcttttgcaagaggactagtaccccaatttaccagacaagattccccacactattgtttatccgctacttgttctaacttatgccccagcccctttggctagaaatcaatatctgttaagtattgttcatcttcatctgagatgactgagttgcctttttctgcttctaataatgcttcccgctcgaattcttgtttctccaatactttgaagaatggcaaatataagccaaaagataaagcgacttgaatcacttgaatgatgactgctcgccaatcgaatcctgtgagaaacccttccataaatattggcacataaggcggatcaaaaatcgggtagttcagtaaacctagtttcatacaaatcattgggaacattcctactaatgccccaccaaagataaatggaatcatcaaaactggattcaagatgatcggcacaccgaacaacacaggttcattgataccaaacatggaagggagtaaagcaactgcccctacttttttgtatcgttgtgacttactgatgatcattgctaaaactaagccaatcgtcacaccagaaccggtaaagttggcaaaggccgataaggtaccattcgtaatgacatggcgtaatggttctcccgcttcgtgcgctgcaatgttctcggacaaatattgcactgcgattggtgaaagaatcggggaaagaaccgctgaatggataccaaaaaaccagaaaaccaaccgtaaaactaatactagataaatcacccatagcgaatctagactgccaatagccggtgctaaaatatccatgatgacttgcggtaaaagaacacccccagataaactatcggtaaccgcacggatcacaataaacagaaccccgatagccgcagtgggcgtgatcaattcgaaagaactggaaacaaaatccggaaccccctctggcattttgatcaccaacttgtgcttcgtgaagaattggtagagtttgaccgaaataatcgctatgaaaattgcagtaaataagcccttagaatcaagatagctggcgacgatattgccgttgtcatccacatccattgctacaatcaaaaaggcaattgctgacaacatcattgatcccactgtataaagcttatagtgttcacttaagaaatacgaaattgctagaactgcatacaaaccaactaaccctaatgaaacttttgaaataatcccaaaaatataaccgtagctttcaaaccaatttgcaactccctgtgtagtaatgaactcaggaatagacggaaaaattgctgcaacagaccctaataatagcactggtgtcattacgaccattccttttttgatcgcagtcaagtaagcattactatcaactttattagcaaccggcaccaatgttttacgaataaatgcttctactttttcaaaagcaccctgtttttttggactttccatttttttcactcctaattattgagttttcaatgcttcattcttacgatatgcaaccaacgcttgtttcattaccgtagccccatccatggacccatagatatccgacgttaataaaacagttggtttgttcactttatctgcttcccctttaatgaaatcatatttgtgactcaattgtggcccaactaagatgacatcatagtcattgatatagcgttccaatttgtcgacaccgattgcctccattggatagtctttttcatctaagctttttgattctttgacaacttttttcattgactccatcatcattgtcgttgagaagcctcctgcacaaacaagcaatattttcatgtttctttcctcctactttttttttgattacttattttcttcgcttttttcctttaacataccaatcatttcttcaatcaaatcgcgtgccaataagcttgtcattaaatgatcctgcgcatgaaccattaatagactagtttctgttttctcgccattcagttcaccggtaatcaactttgtctggacatcatgggcatcaatactcctttctttggcttctttcatttttgcttctgcctgttcaaaatcccctttacgggcgaatcttagcgcttcaaaagctgctcctcgcgaatctcctgctgcagagatgattttaaaaatatcaacttctttttcgttcattgtttcatccttctttcattaaactttgtatataagacttaaagtcttgaaaattcgtgattttggctagttgattgtctaacgcttggtcttccatcattttgatcatcaatcgactgatttctttatgcagatttaaatgatctttcttgatattgatcaagaaaataaccttgatttcttttttactgtaccaaattgattttcttaacaaaatgacatcgatgacttccctgatcgctgcctgctccataggatggggtcctgcgataccattttgatagatggtatcgatcattttttctctctcaagaacactgtgcttaaatccctgctcggcccacccatcttctaaacgagccgcttcgctttctagtagttgcaaataatcttctgattccgtatcaatttgaaaccactgaggatcaaataaactgagaataaactggtgtacatcaaatactttattttccgattcccgcaataggcttaaatctttttcgattttattgatttctgcccgatttaaaatcgtttttgtgtagatgatagggatagcaaactgttcctgatccagaggaacagtggaaatcagtaagtcaaaacttttatcaatctgatcaacttcgttcaaagcaaatgtggtgacttcagcattgctgaaaagccgctctaaattaactttcaataaataagaagcaccgccacccgtagaacaaatgacagctatttttttataatcatcgattaactgattcgcctgcttctcaagactagctgcgaaatagatagcaacgtagcctatctcatctttgctgatatctgcgtccaagtccttgtttaattcactgatgaacaccatcgcaacgttgaatacattggcatattgcgtataaatgtcatcaatgatcggattatctagttgatgtccggtatacagtctttgaagtaatggagcgacatgcatcaacagggcattacctaattcttgatctgttctaaactgtgtatggtaacgtaaatcgacaagctctagtgttttttcaattgcttgtttcaattgctgattactggttcgatcatcaaggaccgaaaattttcctctcagttgctcatgcaaataatttttttccatagtagaaaaagtaatgggataagccgtttccaaataggagaccaaatcttctgttaaaaggtcatacttatcggttgctgtccttacggttcgttcgtcattcgttaaagtgttattttgtgtgattcgaaaaacaagcaatcgaatatgctgtatgatattctcaaaaacaatatcgctcgctttaagttgatgctgttgcaacttttctgataaacaggaacgtagcgcctcttcatcaaagacgaagtgaaaagctttatatcgttccgtcaggacgggggtatggataatgttgcgaatcaaataaagaattgcttgtcttttcttctcttcagtcccgacaatcttcaaaccataatgtgctttgctgaataaagttaatccgtagtccttgcaaaacaattcgacttgtttgatatctgctttaactgttgaaagacttacctctaaccattctgaaatctgctgcatcgtaatgtattcttcatgaaacagcaggagaagttcgatattcttaattcgttcgttcgggttcccgttatcgatcttttcttgacgttttgcatgagataaaaatcttagaaacttttttttatcagaaatttccagttgatagcctgccgaacgaatccgctctattgaaaatccttctgttcgtccgatatctcttaaccacttgatatcattagccaaggtccgctcagaaatctgaaattcagcggccaatgccttgggagcaattgcttgcttctttgcatataagtattcaacaattttttcttgtcgcataatttcctcccgccttcacataaactatacaatgtaagccctttacttaaaatggcaactttttccgataaatgatgcaagaataatctgattcaaaagaataaccatttccttctacgagcaaacgattcggtttacataaccgggatcgatcgatatttttctgaacactgctgatcctgcatcatttcagctgttagcctcattcaactactccattcgcattctaaaaaagataactaatatacaaaaacaagccaaaagcctcgttacaaagctgttggcttgttcaatacagaaccattattgatcgaatcgattcttctatttttgatcaagtatacttctatttatacaccctaatcgcaggaggcacaaaatcagtgacaaatgcgttgatttcggcaagtgattcggcgaaaagaattttgtcgaagtcttcttgggtcaagaacccttctgttaccattgcctggtattgttgtttcaatggatcaaaaaagccgttgaaattgatcagcacacatgggttggcatgttgcccgatcctgccccaagagatgacttctgtaatttcctcaatggttcccggtcctcctggcaatgccacatataagtcagccagctcgatcattttttgttttctttcatgcatattcgagacaacgatcagtgacgtaagattctcttttgctaattctcgtgccaccaagaattctggtatgatgcctgttacttcacaattttcttcaatagcggtttcggcaattattcccatcaatcccgcattaccgcctccatagacaaggttatactgattttcacctagccatctacctaattctttggtgatttgcttgtattcttctgaacttccgatacttgctccacaatagactgcgacattcattctcaaatgatcccctttcgatctgattgcacttcatgttattatagtcgagaaataaggagggctcaatatgaaaatcaatgaatacaactcatgggtgatcgacttttataaaaaacggaactggtatcaatatgatccttttattcgtgttggatttcttacggaagaagtaggagaactatcccgggccattcgcggcgttgaaattgggcgagatcgacctgatgagtctgcaaaagatcaagcctactatcgagagaatttgatggaagaacttggcgatgtctttgacaacgtattgattctcgcagataaatacgatattgctctcgaagacattatgggtcatcataaagcaaaactggaagagcgatttaaagaggaaggatagcctagctgctaactatcacttatatttcttttcctacgcgttatcttgcgttatcctaagttgtgcgcccagttgatcacctgtcattgtcaacgagttagctaagggaaaaatattgtcagattttctagtctacttgaagcaaaaaaaagggactgtgccataagtctcctacaagtaacactagccgaacattaatgattattgctcctgcggtgcagggactcctcgtcgcaaaagtcagagggatctatcctagcaacagactattattcggtttaacttgttggatgatgacttatgtcatagtcccgtattataaatcattattacagatcaacgattgaattttttgctgcctaatttcatatgaaattgcggatcttttggtgtggaaggatcgacacctcgcaaatgaggaatttctccacagatcaattgcaataagacaatgaaattgaacgtcataaactctggatcggtggtcacaggtaagaccagatctgctgcgtctgactcataagtcgtaatcagaaaaatagtatccgaccattcggacaaaacttctttcattttctcagaccttggctcatcgccgttgtctaaaataaagaccatcgaatcttcattgatcgcattatagatgccatgaataaactcttcaaattcatatccactcaccggacaacgcatcgtctctaacaacttcagggcactttctaaaacatctccataaatagctgccggaccagtcacacggatttcttttgcagtgactaatcgttcctgatttgcagaaatccattttaatgaagtctcataaacagcttggaactgtccagcagcagttttcaccccttggatctgttgttcaaatgtctcttcagaaatcgttccttgctcaagtcccagatagagagcaagtaataatagattcagttttgtacaataaaagccctttgtttttgcccctgctttctcaggtccacaatggacagtcagaacaaaatcagccatttcatcaataaatgcttgttcttctcctgccatggaagcagtgatacaacctttgcttttcgctagtttcatagcgttgtaggtggaaaaagagctacctccttgagagattccgacaactaatgtctgttcattatcacttaaaaaagtctcttcagtgatcgtgaaaggatagaccgctcttacttcaagttgtaatagtttttgcatttgcggagccatttgcaacgcggaatgatagctcgttccagaccctgtcaaaaaaatccgagtgattttttcttttttgatacttgaaaaaagacggtctcctttttcgataatttctaacaatttacttggtgtctcttgtaaatactcttgaattgatgccattttttctcctccaatattatagaatgccaatcaaatgaacagcgatcccaaaaataataatgccgatcgtaatcttagtaatgctcgctttttttagcagcttataaatgccaaaggtgaaggctagcggcagcatctttggtaatatctgatccagtatatcttgaaccacgatttctgctccgctgatattccactttaatggagtcgtgatattcagcatcgtcgccaccatacctccaacaacacataatccaacgatcgttgctactgccataattttatccatcaagccctctttttggatacggtccaacgaattgacccctacttgataccccagtttcaatccaaagatccgaaccaatatatttggcaaattatacaaaactaaaaacagcaatggaccaaaaagattgccatcttttgcgatcgatacaccaataccggcagcaatgatccgaacagttccccagaagatcgaatcaccgatcccagctaaaggccccatcagtgatgctttgacagcgttgattgattggacatcaaaagccggattgttcgcattttcttcttccatcgctgcgctgatacccatgatcgttggtactaccgctggtgtcgtgttgaaaatttccaagtggcgtgtgattgctgctgcttgatcttctttatttctatagagctttttgatgactggcaacatggcatacatgtaaccgacattttgcatccgttcgtagttaaacgcaccttgaagagcaaaggaccgccagaatacactttttagctgcttcttctcaatcttattcaaaatcgatctctccttccgtcaagttatctgggacactggggatagactctttcttctgttcaatatagaagtgcaagatcactgcgatacaagcaccgattaaagcaatcgcagtaatatttagtcctccgtaggcagctgctaaaaagcccaagaaaaagaagggcgccattttctttgaaaaaagcatgtccagcaacaaagcaaatccgatggcaggaagcagatttccagctacagataacccatctaatatgacatttggaacagcttcgatcattcccgttaccttatccgcacctaataaaatagctaagaaggttggtagaaatgtacttaaaaagaacaaaccaactggaatccacatacaaaaggctaatcctttgtaatttgcttctttcgcatagctatctgctttgtgggtaaaataagcattgatgatccgaaccaatacgcctaaagattgcgctaaaactgcgattggcacagctaatgctaaagctacttcaacaccgctattagacaaaatcgcaaatgctgttcctaaaatccctcctgtcaccacatctggcggtgtagaagccccaataccggcgatccccatccagatcaattcaagttgcgccccaatgataattccattctttacatcgcctaaaaccaaccccaccaataaaccggtaacaagcggacgatcaaacatcatctgaccaaatattctgccatctaaaataccgattccagcaattaaccctaacattattgcttgagcaaccatcgtgtaaccctccttcttctaaatgtcaaagtccgtcaacaatttctttttatctctaggcagcatccgaaattctacttggacaccggcatccttaatcatttttaagttagcgatatccttttcgtccactgccactagatccgttaatttctttttcccctcgccataacgcaaacccccaacatttaatgtggtaattaccccacctgaagcttcgaccaatcggcgagcatcctcggtcgtcttaactaaaaccaagacattactcttttttgatgatgcaaatttttgaacgatttctccggattccgctactcctcgaatgtatagaacaacattggaaggtttcgccagatttaaagccatagatttcatttgatcatttttggcatcgtcatttaccactaaaatcgtattgatccctaaggccgtcgtccagccaaaagctacttggccgtggatcaaccgatcatcaatcctcactaaagatatcgtcattgttttgtcctccttgctgtttgattagttgattaatgtgtaaaattcctttcttcccttcttctattcccctaagtacccaatcctcaacagatagctcagctgtttcctctgagagtatgagagaaagtaacataggtaaattgacaccggtgattaactggaattcatatccgtttaataaatgattggtaaatagatttgccacacttcccccaaagacatctgttaggacgatcaacgtctgatcttgattctgctctaagtaagcagtcatctctgcttccgcatcatcactcgatttttctttggtcattgaaaaacaatcgatctcgatatcttcaccagcaatcaatttcaaactatcaataatccctttagaaaatgtgccgtgggttgctactaaatatttcatctcttttcctcctcactacacttttttataatgcaaaaagcgtgccaactagtgacacgcttcgaaaagtcctcatctatcagtcaagaaaaaggatattatggatatagcaaatttctggcaatggaatctgcacactatagattgtttccagcacactgaccgcatctttgatcactctgatttcacgttgatgaataaatacaaattgttcaagatctgcaaattcggtaatttctacttgccgtatcaaacgctctaccatgcaggagatatgaacataaagaccgatttttcgtggattcgttaacttcagtgctaatcgttcttccagtgtgacaattaattcttctatgatcgacatgattttttgagtatctaaaatagttaacgaatcgaggactcgaatgagggaaaaattttttaccatccgatcattcacaatcttcatgccattttcatccaaatcaacgccaaagatctctgacattttttgcgcgttcccaccagagataatggtttctaaataaacaaactcggcctctggaatcagaggatcgtcggttccaataatgcctaataaattatagtgttgagaaatactagcgggtatcccgttggtaaccaattcactatattccatagggaaaaacgctacctcaagcaatccttccaaacattccgacaacattttttgaatctgaatcgctgtacctatcccagtaaagcaagtggtgattatcgcgtttttttgagccttttccggttcgaacagttgaatgttcggtgagatcgattccttcatccgttccgcaatctcggttaaaggagtgccttgaagcatcatattgccaatctctagtgccatcaaagtccctagctgatccatacacaaaattggaactgctacggtctttttcaataaatcatagatcatattcaacgaccccatatcaattaggattaccagtcctttgactgttccgttttctcgtacatactcttctacctttgtagagatgtcatgaatggaggcctcgattggcatatcaaagctggtaaatattgactctcctagcatgcgattacacacattggcgatactgctagcggttgcgaaaccatgagcaatgatcaatccatcaatgtctttgctctttcttgtataacgtagtgtcgaaaagaataatgagaagagattaatgtctaatgaatcgaactgaatatctaaacgtcgctcaatttcaggaaaaattttctttagcgtttgccgttctttcccataatgctgctcaatgtaggcttccagcaaaaattcagaaggctgagaaacgaaagacgttctcaaaatatacttgtaaatgtagtgagacacaaatagaacgaagcttccatcataatgaaagaacgcctgatattcgatttcccgaaataattcttgcatcgtttgatgcacaaactcttccaaagcaactggtttttgctttgaatccgtaaagactaaccgatccataaagccaaccacttgttgatcgatcaacgtacgcatctccgcatcctcatcattttttctcaacgaataaatttgatttaatcgatgaataaacgcataaaggtcttgccggccatcattttcggaaagagattgtttttccccgtcgaaaacgtaattagttgactcagaaaactggctaacgattttatttcgaggaagcgtatacatttgtgcaggcagatccttgatggaaacatggacttcatctgaagtaacattttgagaaatcgcactgccgcaaacatacttaatggcattttcaatttcaccaatatttcctgaataaatggtatgaagaaaaatattcattacctgcgagctgaccactattttcttttcaagccgtttgctttcaacttgaaagagcttctcgataatttcttttttttctaaaatactgcgttcgctcagattaggtaaatagatagtaataggaattcgacgcaaaaacgtctgtaaaaaagcggtggttttctcagttgtcgcgaaggccaatcggacagttgcttttcgctcggttgattcaccgatccgagaaaaggtccctttatccatgaaagtaaaaagtttctcctgtccttccgcattcaaccgatggacttcatctagaaatagtagaccaccattcgcatcttctaataacccgcgcttcttttcgtaggcaccagtgaaggctcctttggagtaaccaaacaataatcctgacaagagctctggattattataatattgtgcacaatttaatactttaaatggagctgtttctgatagaacttctgctttgaccatatattcatacatgatttgcacgaaataactttttccgatgcctgtatcccccattaccataacaggaagaccattatttggataaaatacagctgtcttcaattgttcaatgggttcagccaaacttttatcgtaaccgatcactttttcaaatacacgattgataggtactttctcgattttgtcacttaactcttttactgaattcaggacttcagatacttcgatagcgaacttttcttgataaccccctcgattgccaaacaagacgggccgtgtattgattttaaaaaaaatgccttgatcaacaaaacgattggccaatcgactcgcttgtgttcgactaaaggagagttgagcttcaatatcggctgttgtaaacagtcccgattcaaccgcttctttagtagcacgattcgctaattctcggctccatgtagtcacttctacttcaacattcatttctacacctctttctttgccctcgaaataacaaatgttaaaaaagagtataccacggaaaaatttcttttaaagacgaaattaaatctcacagagaatcgctttcatttatttgttatttcatggcctgtccaatgcctcatactttctgtttttattactaaacaactttgtcacaaaaaaacatcgaagctgctcaaaacgcgcttcgatgttctttagtaattttatttttacaatgaaccaagtttccatataaaaagctcattatcaacgaacgaataggattgtgttgttattcgaaaacttcttaatgatgtttgtagctggcatagtaaaagccggatacaaatagcgcacctccgatgatattcccaatatagacaggaataaaattcgcaaagaattccaaccatgtgccgtggccttcgaagatcgctgctggaatgacaaaacaatttgccacactatgctgaaacccgatggcaacaaaaatcatgactggaaaccatatcgtcaatactttcccagccgcatctttcgcaccataagacaaccataatgctaaaccgacaaaccagttacagccgataccagaaccaattgcttgtaaccaagacgcagctattttgtgatcagcaaggtgaatgatttggtctaaataaactcctgaacttgtcaatccaacaaagtgaccaaaaaaatacgccacaaaaatcgcaccgaccatattagctaaggtaatgatcagccagtttttcactagttgcagaaacgtgactttcttatccataaaagcaatcgctaccgccatcatattccctgtaattaattcaccgcccccaagcaggatgacaatcaatccgattggaaaaaccgctgctccaactagactggtgagacttgaaagtgattctggaatagaggcagagactctaacataggctaaatagccaagagaaatcatagcccctccgatgaatcctaaaataagtttcgcaatgatcggtttttgtacttttttggtgcctagatgaatactaatgtccataatttcttctggtgtgtgcataactctttgatccctacttttccaatagattttctgataaaaaacaatagtgatttccttcacatttccatcaacgattataacaccatcgtttttgattttgcattgttattgtaaaaaaattcactaaattttcatcagattctattaaaaaaaccccggttaaatcaacgtccgttgtttaccgaggaatccgtttgtttttgatctgggaaagcactctagaagcaaatccccttcttgagttgaatatcttagaattgaatgactaattcagctcttttattatttaaagtcctttcctttaaatgcgatggcatccacttgaaacaagatgcctacctcaccacggtgcgcaaaagaagtctgaatagactttctgacagggtattgtccattaaatttttctttgatgattttttccattatcggaatatcaaagatatctttgaaaagagcgtccatttggaccacgtctgctaacgtaagtcccgctagtttcaaccgttcttccaagtgatcgaaagcaccgattatttgttgttcgaccgattgtccgatatttccgacacaatagccaacaaagactaaattcccagcctcaatcactcctgaatttgcccaatctcggttaatgtcatagcgcttcatctaactcgcctcctgaaataatctatttgaatttttgtctgaaaaaacagcctctagtttcttactaaaatacataaaattgttctgctttattccaacgagatactcaacacctctctcactttttctgcacctttaattatcgcctaccacttagaaaatgaggcgacatgtttggtgttaaaaaagaaaggttgcgtcttgttcccttatcttcaacagtgaatcaacacagcgattcgaacacacgtggtccatattgctgctcgttcgatagctcttttcgctaatcgctttgatccttttagaaaataatctccaaccaggcgctggaaaagcatagttacgtctcagacttttactcccaccaatgattacttcagcaaggcaaacaaaaaagctagttgatccttctatcaactagcactagtggaaacagaccggcagccactactccccgagtcagaaacgaaaacagttaggtagcggttaatgtctttttgctcactagcccctcctttaagcagcctgcttacgaagatatatcgagaatttttctaaaagctgtcgactggatgatcttactaagaatggtataagtttgtcgatcgttctttctgagcaagtttaagatattcgttacttctgcgcgatcttctgctagaaaggctttaaaaaaagcaaagtagagctgcgtggtcagagagaaggtagaatcagtaagcgattccgtcaatttttcatctaagagtgatgccttctctaactcattatttgtaatcaagaattgaatcatattgacatacaatgcgccgattagtcgatcaatcaactctgggtaaagtgaccaccaagtgattgcggcagcaatcgcttttgagagtaatggctcaattcgttcttcctcatcaaaaaagataaaaaaagttgtaatgaacaattccagttccatcattgaaaaactctcaagacgtgtgaaatattctcttaaagtcactaaaggccagtgatcgatggtcggttttagtgaccaagccaaagcatatgctgcagagctgatcaaccgatctgagcttatctctgacgctttattgtccctatagatcactaataacttatcgacagaatgcagattgaagtcatagtaaatagcaatgacgtctctaatcgtgattcgtttagttgcaggattctccttatcataaaggaagaaaaattctggttcactcatattcatattttctaagatacgcttgaatttaaatgcttcgatcgcatactctcctgcttcaaatttcgcataaaagctgcgggaagctacacctgaataaacttctttttgagtgtagtgtttcgacattctgatttttttgatcaatgggccatacgccttcatctgaccactccttttcacgtatagtatactacacatttttaaatacgggggaacatttaccgatgatatagtaacggtaacaagtggaaaggtggtgttcagatgaatacagtactaagcttacaagcatttaaagaagattctgccgtttctccaaattcaatctttacgtttaaatgtcaaatctcactaaaagtaccagcaacaaaataaatgcgattaaaaaagaatagaatactcccccttggtcattctaatcttttttaattagatacaaagagatgtcaaagtcccccttgcttaggtttgatccttgtcgagcaaaaggggaataaagccagtttttcaaaaaaatgaaatcaatacgtcaagaaaagagggaatcaatggatttcatcaatacattccacttcatctatcctgatctaaaaaatacatatacagatcaagcatttacttatttaaacattaaccagaacgttcccaagcaaggatggaaaattcatgtttctgctacttatactaattattttttgatactgagcgaatgtatctcatgctgtatcgaaaatgatgtagatatgaaatttttgaagaatcttgatcagtttacaaacaacctttctaaaagtacccctagagcctattcaggaaagttcatcacaatctatccctcaactttagagaagtttattgtgatgtgcgaaaagttatatacccgattaaatgattttcagggaccttacgttctttcagacaagagatataaagattgtaaagtcctctactacaggtatggacgttgtcgagcggacgaaaatgaatcagagacagaaagaaagcaattaatttgtcccgatggctctattatcgaagacaaacggttgccttattattctcagccgccttttgtacaagatccttttcatgatagttcacaacaagagaacccatctgcattgctgaataatagatacaaagtagaaacagctgttcattactccaataccggcgatgtatatttaggaacggatactatcggcaatcgaaaggtgattattaaagaagcgcgcccctatatcgaatcctcttcatcaggtgattgtattgacatgcgcaagaaagaaatagccttctttaacctttttccgcagtattgcccaaaggtttatgacagtttttacgagtgggagcattattttacggtagtcgaatttattgaaggacccaccctctctgagttctcagatcgagtagttgaagaagtgtatttcgacgatcttactggcagctatcgccaggatgctcaaaagataatcatcgagttaatgaaaatgatagtagcgattcataaatttggaatcacgattcatgacatttccaatactaatattatgttacgagacggacagccagtaatcatagattttgaaggtggaaaatttgcttttgaacaatacgattacatcgtaaagactcctggttttgataatggggatcattcaatcgacagaatgaagcgagattatgtttccttagggctcctgattattaaccttttcatcggaacaaaccaactggcgcaattggatcagcaagcagcactggagacattttatctttttgcttgtcattatcagctagaccctcgttattattcactgatcagcaatttactattgagacctcattcgacgaaccttgaaatccagctccatcttatgtgcacccacccacttgaagccgtctcattagcgtataacgaaataaaagaaaatctattagctgatgatctttccaacgtggataagaatgcagttcatttgatcgactcaaaaagcagttcggttgatttaacagacttagcaaacgaaaaagaactattcattttggcttatctcagttatttaatggacaatcaaaaaataacttttacaaataacgtagatttctcttttgaaaaaataggacatgtaaataaaaccggttcggttgattatgctcacttgattattcttgttttggttatgagtccagcagaaacgatcaatcgattgaaacctatgattcacctctggatacaaaaattaatcggttctcagaatcaagatggcagctttatttcagaatttgatggggttgagggagaggggcttcttgatggtgcagcaatgatcgtctgttcattggtggaagcttatcgtttttttcgtgaggaaagaatactccagagtcttactgattggctgaactatacagaaaaatttggcaagacacatttcccgcaaatcagtaaaagaaatgcgaataaatcaccttatttggcaaatggtaaagccggtctgctactggcaaaatggtatgttttgcgaagtggatcagggacagaatccatgaaaaatgaaacctttgagcaaataaaagaactgccactggtttcttcaaatgtcagctttggatacggtattagtggtatcgcctatttgaaagttctgacaaataatctcaaaagaaacgattacaactctctattaacgaatctactatcctacaaggtcaatttcaaaggaaagaatcgatacccggactgcaccaattcaagaatagaagcgagatttctcacaggggaaatcggcgtcttattcttagtggattgtatccgacagagattggaggatcatcagtgaaaacactctataaacattataaaagcaatattcttaaaattttgttgctgtcaggcctcttatcctttttacgcgttctgccaagttatctactggcttttgccacgaatgctatctttgccagaaatatcagccaatttcttttttgggacctagtgattctcattctttggctgatttatgtctgctcaaactatttattttcagtttatcaggagaaagaactacaaaaaatcagtctttcattgcgaaaacgtgaagctgactctatcaagacagtcccattagcagacttcaataaaatcacggctgatggctatgtgtcgaagctgacaaatgatatcacacaaatcgaaacgcagggcgtgatgagtttatatcgtcttttttctaacggatggttgattttgttctcaattgttgcattggccctttttaacctttggctggtcgttttggtccttggtttaacgggattgatcctttatatccctaataaattcgggacagtccttgtggcgcttggacaaaagttatctactagtaattcctcttatacaaaaaggattgccaatatcttaaaaggttacaacgttttccgttacaataataggctggcagaaattccaaaaaagattaccgaatactctcaagacctttctgagaataaggttgccattgcaaaaacaaatcacaagattatgaacctcattgctttttctagtttattgagtcaagtagtcgtagatattgtgacaggctttctggcaattatcggacaaacgacgattggagctattagttccagtggcaatttagcagcaaacatctttaactctgtatcgttggtaggtcaatcggccatggaactaagatccatagagcccgtcatagaaacatttgttgttgataagccaatcgttcgcgccacgaaaaaaacctacaacgaattcactgattgtatacgaatcgaaaatttatctttcggctatgacgcaaatctcccgatcctagaaaatttcaatttagacataaaaaaaggggggaaatatctcctcacgggtgatagtggcagcggaaaaagtactttattaaaaatcttgattggtgatttggaaggctattcaggcgaaataaaggtggatggtcatcagttgatggatgtggatagccactcttttattcaatatatcgaccaagacaattatttgttcaacacttcttataaagaaaatgtcgctctttggaacaactacgcaaacacagaaatagccgaagcattgaataaagccgcggcagattttgtagatgatattgacaaagtagttgaaaacaacggtaccaatctttccggtggacaaaaacagcgcattggtttagccagagcctttattcaaaaaaaatcagtcatcctctttgatgaaggaacctcttcattagataaaaagaatacgttgctcattgagaatctccttttggaagacaacgagttgacggttgtgatgatcagtcatcatccactggaagaaaaccttcataaatttgatcaaattatttctatcagcgcccctttaacgcccgaatatcaacggatggccactgccgaaggttaacagttcatgaaccgtggagcaaaaaattctcattattataaatcttctgaaaaaaagtgcctcccaatttttggaggacacttttttggaagtcttttattcagattttaacagctgatgaaaagctgttcgcaactgctgcatcttctgtgtagcggatggttgatttgacgcattgacagaataataaattttaaactttggttctgtacctgaaggtctcagacagacccacgaaccatcagtaaatgtatattttaggacattggatgatggcaatgtaattctttcgattgattgaccggcaacccaccgttcagaagtcaggaaatcttctttgaccattaagacaaaatcccccaaatgagaaaatgacagggatcttaaacgatctagctgctgattcatttgcgacaatccatctttgccaggaaaaacttgggtttctaattgttcctcgtaataaccataacgttcatagatttcattcaagcgatcaactaaatcaattccgaaaaggaaacagtccagtgcggtctcaactaataatacagctgcttgaatcgcgtctttatccctgacaaatggggctaccaggtacccaaaactttcttcatagccaaaaagaaaggttttatcttttgtttcttctgataattggatttgttccccaataaatttaaatcctgttaacgtgtttctaacttcaatgccataagcttcggcaatttttgcccctaaatcagatgttacaatcgtttttgcgataaatgaatttgctgcttgttttactcgaaccaaataatcaagcaataacacccctatttgattgccatttagaaagactggctgtccgtccttacgtacaacagcacccaagcggtccgcgtctggatctgtggctagaattagctgtgttggctgtgtttgagcctctttcaatgctagagtaaacgcctgttggtcttctggattaggagaagagacagttgtaaaatcaggatcaggcagttcttgctctttcactgtccgaagattcgtaaatcccaagcgttgaaaggccttttgtatcaatacatttccagtaccatgaagtggggtataaaccattgaaagctgtgagccaaaatggcggatcctttcaggattttgggccacctgaatcaattgatctaaatacaacgcatctacttctttcccaaaaatatcaatcaactgttgctcgacataagttgacaataaatccgcttcgatcattaattcattttgaatacttgctaatattcccatcaattcttcggcagttcctagtgtaatttgaccgccgtccgaagcatacactttaaatccattgtattgcttaggattatgactcgcagtgatcatgacacctgcaaaggctttataataccgaactagaaaagacaattgcggggtcggacgtaattgatcagataaatagacccgaatcccctgactggctaatacgcgagcggtccattccgcaaatcgtttagaaccatgtcgattatcaaaagaaatcactaccccctgttgttccgcatgcgctttttgaacatagcgagctaatccaagtgctgcccgcttaatggtgtagtcattgattcggttgatgccaacacctagctctccccgcatcccccctgtcccaaaagccaaatagtcataaaagtgttcttctatcacagcaggatcagacagagcgagcagctgatctttcaagtttgcttccaaagatggataatctaaccattcttgatattttcgttgccaattcattttgtttcctcttttaattgtttgagaatctctgcaatcgacaaggtgcagccagccattgaagtatctgctacgccataatacatcgtcaattgatcgccaatttgtatgccaccacagccaaagacgacatcgccaaagaacccattcttttcatagtctgcttcaggttccatgattggtttttgacttctagcaaggactctcgttgggtcttgcaaatctactaaggctgcacccatacaatagcgatgttcaggagtcgcaccatgataaataatcaaccagccttcgctggttttaataggaaccaacccgccacctacacgcccactgtcccaacaatcttcacgaatccctagtaaatgccggtgctgtccccagctaactaaatctggcgaagaagcaatccaaatgtcatagttgccaatgcttttcagagagggacggtgtaaggcgtaataacgcccattgatttgttctggaaaaatcagcacatctttgttctctggtgcaaagatattccctaaatcttgataggattgaaaatccttggtagctactaatgaatcacaaacacccattggtgagacagaactaaagttgatatagtaaatatcgccaatctgtgtgcatcgcgcgtcttcgatgccatatgattgatattcattgaaaggatacaagaatgcctcctcatcaatcgtaaaatgatgcccatctttactgcgggcaattcgaatataagaaagagatgtcagatagacaaaactatccaacttgtcttttttgcggatcattctcggatcgtcaaaatcataatctggatcatctcggtggaatgttaatacttccatcgtttgtgttcttggatcaaatacaggcgctttaataacgttaaggtcgtcagagattgggcgctctgccacacgtaataaaagtaagacttcatcgttgtattttgctactccaccattaaaggcgccaatcacttcatacccttcatgtaatggtttcacatctgcgggagtgatcaatggattttcattaaaacgttctattttcatctgcttaacctctatctaaatggattttctagtttgattttctgcgcgcctgcatcactgatgccggcatatagtacaatatgatctttatatatatgaataccaccgctaaagacgacatcttctaaatctgggcgtttcattggtccttgttggaaatcgtttctttctgcaataatttttgcctgtgtcatagcaaattgatttcgttccagacagaaaaccatcgcataataatgacgatttccttgatcatcgaaattctcgatatggcctaagacccaaatgtcgccatcaatctcatggatctcattgccgccaccccattcgctttcacagaactggtcagacagtaacggggcttctgtaattgtttcaatggtcaaatcactaagagtatgaacgatcgttgcacctatcttgcctcggccacctttagttccttgcggtcgtgtcagcactaggatttctccagaagataattgtttcaagcgcaagtctttcatcccccacggcccctcaaagattttctttgcttcggaaagagtcgccaagtgataaaaaaccgtacgccaattcgctgtgccatcttctagaaaaacaacttcaacccccccaaggatgacttgtccgtcaattcgagtataaaaaggatcctgtaaagaaagttcgatactatcagcgattagtgtccacctgtttgattcaacctcttcaaataaactgacagtggaaacttcactgtctcttgattcaatgcgacctgcaatcacttctttccccgccaattcaaaaggggcagtgatattataaacatcttgatcacccacaccgctaaatcgcaaaattgcggcttttttgactactttggctttctcatttcgatattcctgcaataattgcttgatataaatcatagctgctcctttccaatccaacatgcctttgccggcagatgaacccagtgaccatcttcacttaacatgccatttccaaaaatggtctttcgatttccttctaacgagtgcttgatcggctgtccaaaatttaaaataatttgtaggctttccgtttgataactcaagcaatctcctgttaactcaatgttgcggatggctgtaaaaggtccttctgtttttcgcaaccgaatcagtttttgataatctgccaaaatccccttcgcctcctggttcaccgctgccaatccgatccaaccgctttgctgatttgatagccaaggaagcatgcccctcgagcggtcacgattcacttggttggccattattaaagcgtgtgactttcctcttaaaatcagttcttcttggtatttattttttgcttgaatatccctgatatcagctagctgctgaggcaaatagtcaccgacaccttgttcttctccctgaaataaaaagggaatgccacgattgatcaacagaaacacggtcaataagcgatagatgtcgcggttttcatttgcaagccgctgccatgaacggctcatatcatggctgttaaagaacagcgtaggcattttcttttgttgactcatttctttaaaatccctagctagtttctcaagatccaatgcttccatgctgcccaaattaaaatgaaatgcggtatcgaacaatccatcttctgtataactgttgatcaatgagagttgatccgagctaatttcagccactgtaaaaattgatggatcgactgctttgatccactgatttaattcctttaacacacgtttgatccccggttgattcacatcattgcgatgatcttgtttcccatcttttcccactggattatcaataaattgatcactgaccgtcaaattattgatgacatcaaaacggaacccatcgacacctctgtctagccaaaattgcaagacatcaaaaacggcttgtctcacttcttgattctgccagttcaagtctgcttgctcttcggcaaagctatggtaataatattgatccgtagccgcgtcatacttccaagcagaaccacaaaaaaaactttcccagttgtttggttgatcttgccatatataccagtcccgctttggatgttctttgccactggctgattcgatgaaccaaggatgttcggtagaagtatgattaactacgacatcaatgataattctcatttctagctgatgggcttcttccacaaggagatcaaaagcggctaaagtaccatactgaggatcaaccccacaataatcggagacatcatatccattgtcaactttaggcgaaggataaaatggtgttagccagagggcatccataccggattcttttaaatagggcaatttttcacgaatcccattgatatcgcctattccatctccgtcactatctgcaaatgaggcaatataaatttcataaaatacagcattttcccaccacattcgttggtctccttacttcagtgtaaattgcattccatcttggaatcgttttgaaaaaatcaaaaacaaaaggatcaatggtaacgtgagcaacacagaggctgcatacattggtcccggatatgtcccataaggcccaaacatttgcgaaatcaagacatttagcgtaacagtggcgtcactctttgaaacgatcatatcccaaagcaggttcgtccaacgatccgtgaataggaaaagaaaaatcaccgttgtgatcgacttagacattggcaataccactttgaataacacttgcatttccgttgccccatccaactttgcagcctcgatcaacgcatcgggaatggctttgaaaaagttggtatacataaaaatcgcccataaactaattgcagtcggaatgatcattccagcataagaatccaataatcccactttggtcaccattagaaattgggggatcagcaaaatgatcgctgggaaaaacatttgaaagagaataaaatgattcacgaatttcttccctttaaattcgattttggcaagcgcataccctaccatcaatgcaaagaccatcattaaaaacgttgcgatcgtagccacgatcgtggtattcacgaatgcaccgatccaaggaacatctgctgaagtggccgaaccgccaaacagccacgtccaagaacgtaagctaaaagtggtcgggataatttttcgatcgacttgatcccaagcagcaaacgagtgcaaaacaagatagacaaaaggaaacgtcatgaggagcatcaccagggtggttactagatataggacactgttctttcccttcgttcgtttattgccaaccatttttttcaccccacttttctagtaacttccgaataacgccgatagatgcaaaagtaacgacagaagccattagtgcaactgcagacgcgtagccggatttcaaattaacaaaggcttgattgtagatttccatttgccatgtattggtcgcaaagtttggtccgcctcctgtcaactggtagacctctgtgaagataccaaagctgatccccaccgccagaactgtaaccgtaaagaatgctgggtacaacatgggaaaggtgaatttccaaaaccttgtccaaggactcgcaccatcgattgccgctgcttcatacacttctttgttgatattccctaagcccgaaattaggatcagcgcatagtagccagacatcttccaagcgatcatcagagaaacgatgatgatggctgcatggggattacctagccaatcaatatcccagcctagtctcgttcgcaagaaggtattaaagggaccgttgtaggaaagcaatcctttgacgatcaaagaagtgacaaccccgcttgacaggtaaggcaagaagaaagccaccatgtataaccccttcagctttggcaggctgttgactaatagcgcaatcaccatcgaaagaaccagcgccattggtacaaagataatcagaaatttatatgtaacgacgaatgcagattggatcgctggactttttatcgcatcaataaaattctgaaatccaacaaattcaacggtcggtgaaatcatattccaactcgttaatgctagccaaaatgaccaaaataaaggaagtagaaagaaaatcaatgtaaaaatcagataggggctggtaaatgaccagcccaattttgtgttcttactcattattgtagcgccccttcgacagctgtcttcgcatcgctcacagctgttttcgcatctttttcaccccgaacaactggcacccatgcttgttcgccaaatacttgctgaatgtcattgtatttctcgttgtccattgctggaaccgcatacggtacattctctgcgtagactttcatcgctggattttcttcaaagtaggctttgaaagcatcgttttctgttgcatcatcgcgcgctggaataagcgaagtcatttctagtaatttcatgtcgttgttttcatcagaataaacaaattccaagaatttcatcgctgccgcttgttcttcttctgttgcttgggcgtacatcacgattcctttagcatctgcataggtggatacttgttctgcatccgctaaagcatcaggtaccacaggcgtagtaaccgtgtagttttcaccaaacttcagctctgggtatttttcttcccagttagggaacgtccaaggacccaaatcggtcataatactatcgccgttttcaaagggatccgttgcttcaccggtgcgcagtacttttgcatccgctaatgtatgcatcaaaccaaatacatctgtcatggctgcttcattagctgtgaattgattgttttcgacaaagctcgcaccttcactggccgcattgtagagtgggaagaaatcaaaccaacgcatccaagccgttggatctgctaagtcttttttcgcccaaagtgctttgtccgttcctttgattttgtcgacgactttcaataaatctgaataggttcttggcacttcatcaaagcctaattctttcaaactatctaatcgccagccaaacaaaatcggattggaataaacaggtagcacgtattgactaccatcagagaatttccaactatcgatggtttgactcatattacgagctttgacgatcgtatcgaaagaatcttgtttttctaatggtaaaatagcctgactagcagccaactgggcagcaaaactacgattgatgttttcagataatgttggtgcggtgttagaagcaatcgcactttggattgttgcttcagaagatggactttccttcatttgagaaacttcaactgtaatgtcttcattttgtttctcaaagtctgcggccatttcttgccaatacttcaattgtgttggattgggtgcagcccaaaaagtaatctttgtcttcccatccgttgccccagaaccgctctcttttgattgattgctacaaccagtgaataaaactgtcactgccactaccgcagcaataccaaaaagcatttttttcattttcatgatcgttcctcctaaatagtaagcgatttctttttacaccgtcatcataccacccgtcattttaattgtcaacattacgtaattataattacaacattacttttgtaattgttttaggctattaattttgtaacattatggtataatcaatataagactaggagaaataaggtgaaaatatgaaaaaagcctctatgcaagatattgccgatgcattgggcatctcaaaaaattctgtctcacaggcgttgagaaataagcctggtgtcagtcaacaaaccaaattactcgttaaaaacaaagcagatgaattaggctatcgttatcaaacgatgaatgaagataccacgatgtcattcttattgatggcaaccgaatttgctttttctcaaacgagtttttttggcgaaatcgttaaaagtgcagaagtagaagctcaaaaaacagcgatcaaacttgatacttataccattacagaggaagacttacttagcctaaagcttccgccaaacttaaaaaagtatgacggtatcctgatcctgtctcatagtaaaaatgcctacatcaagaaagtaattgatactgggcttcctgtcacattgatcgatcaccatgatccttcactcacagcagatgccatcttgacaaaaaacaccgacggaacgttccaagccatctcacttctgattgaaaatggaatgaagcgaattggctttattggtgatacagcattttctcccagctatcttgagcgttatcgcgggtatcaacgggctttacgagaacacaatctaacacatgatcctacgattgaaatcacagaaattgaagaatctcaaggtgctttatttaacagcttaaagaatataaaacaaatgccagatgcatggttttgcgtgaattctgggctagctttcatgttaaacagttatcttcaatcttctggttacacgatccccaaagatatcagtgtgatttgttttgatgaaactgaatttacacgcatggcgattcctcaattgacaaatatcgctaccgatctgcagtttatgggccagttggcgattcgaacattggtccatcgaatcgcccatccccaagagccaatcgtccatcagcaaatcgttccgcagctgaacatccgagaatctgttcgacttattaaagcaaattaaaacaaagcgctaaattctcccacaaggtagaatttagcgctttgtttttgttgaatctattgtactggttacttccccctaagcgaagcaggcgaatctccaagagaaacgagagtcattggatcaagcagcaaaccagaaaagaaggcgaattaattcttgattgctttaagagatttccctctaattttccaaaaagaataacctgcaatcacgacggcaattccggcaaggatccacggaccggtgcttcctcctgtgactgtgatggtttgttcccctagattggcgttgctataagtgatcgtttgactgctggttgcttctgcttccgcatctgtcaaaaaaatggcattgctgtattgctttgaaccggcttttttgatgattccgccataattgatctctttgactttaggatatgcttcgataaatcgccgcgtctcatgggtattcccaaaaatgatcatgatgttttcggcgagttgttcgatcttaggcattttagcaattagttgatccgttgctaaaatcgtcagcttgatacccgccggtttggaaagattcaacgacatcttcttgaattcatcattggcagcttcatcgtttgcgacaataatgcggttgatattaaaaaacttactccaagaaaaaacaacctgaccatgtaacaaacgatggtcgatccgtactaatttgatcataattcatcctcctctgctgttgcttcgactagtaatttcttgcaatttacaatagattgctgactttcctgaataatagctgctaattcttcttgcgagactcggttgacttgtgtcgcaagcgtgatcaccaatggaagattcattccagcgatcagttccaaatcggggtgctcttgaacgaccctcagcaggtcgttgttgacactccctccaagaatatctgtaagaatatacgtgtctgccaagtctactttggctaatatattctgaatttgctctgtcatcggttgatcttcgtctcgaaaagcagataatgcataaatgttcgaatgatctcctataatcattgcagcagtctgttttaatccttgagataactctccatagcttgctagaatgattgttgccatatcattaaccctcctgtctgtttacacctttctataagcaaaaggcgtgccaacttcataaatcgctgtcatagcaaggattctatcagcattcaacactgggaaaaagcgtgctgagagagtgttgggggggagtgttggagggcagtattggagagaacattagaaggaagtcttagtttattgcaactcttggtgtaacgacttgctgccaaaccaaccgctgataaactgataaaccaaaaaagcgtctagacaagcaaatcattgcctaggcgcttttcttaaaagataaatgttgtatcactgtccatcaaacagaacacttctttacgggtatatgcttgcggtttgctgcatgataatcactgaaaactttcttcgatctcatttagatgaaaacaagcaacttccgccgccccttgttggatcaatcggggtttttgcatgtggcatttttctgtcgcgtagatgcagcgaggatgaaaaatgcagccagttggtaattgcttgatgtcaggaatatccatacctttcaaaggcaaatctgggacagtgtattgccggttagcgactccttgcgggacggctgctactaatgcccgaaaatatggatgattcggatgattggtggcttgtcgaatatcaccgacttccatcacttctcctaaatacatgactaagagtttcccatgatctgaaatataacgggcagtggcaagatcgtgcgtaatataaacaaaagaaattccatacttctgattcattctccgcaacaacttcaacaaggagatccttagagacacgtctaccattgaaacaggttcatctgccacgatcaattctggttctacagataatgcccgtgcaatcagtacacgttgccgttgtccgccgcttaactgatgcgggtatttatcaatgaactgttctgtaggaaataacccgacatcggctaatagcccatgcactttccttcgcgcttcattctgatccttagcgaatccatgctttcgcatcgctgcttgcagtgaatggaaaatcgttttgtaagggttgagtgccgcaaaggaatcttgctggatcatttgcactttgaggcgatacgcctgatattctttctttgtcatcgtgcgcaagtcttgacctttataaagtacctttcccgctgtaggttgatggagatccgtgatcagctttcctaatgtcgtcttgccacagccgctttctcctactaatgccaagctttctcctggagcaagcgacaaatcgattcctcggagaatcgctggctcatttggcgaaaaagctttgtggacagctactaattcaagtaatggactcatggtcttcctcctgtacctgtttgaagtggatacatcgcgcagcttgttgtttactgacaggaaaaagcatatggcaagtctcctcgctgccatcacaagcaatgcgcacagcgaaagggcatcgttctttaaagcggcaggtcgcgtccgctttagctaaatcaaaagccactccttgaatcgatgaacgtgtatcaatagcatccgtcaagctaggaattgccgccaataacgctttggtatatgggtgggcaggatgcgtcatgacggcactcacctcgcctacttctaccagttgtccagcatacatcacagcaatacggtctaccattgaactaacaattgatagatcatgggtaagaaaaacaatcgtaattcctttctcttgattgattttccgcaaaatagccagaatatgccattgagtaatcacgtccaacgctgtcgtaggttcatcaagaataatcacctgcgggtcaagcagcaaacttaatgcaatcagcactcgctgcttcatcccgccgcttaattcaaagggatacatttttctgactccttgatctaatcgcacatattgcagcaaatcattgattttggcatccagtagagcatcgcccgttttttgatgggctactgctgtttcatagaaatgttcctctactgttaagatcggattcaacgcactttgtgccgcctggaaaaccgttgcgatctcccgccagcggtaacgattcccttcctgtgaaggcaaggaaagaaagtcaactgcctccccagattgccaataatatacttgtccagccagtatttctcctggctcatcaatcaagtttaaaaggccaaaagccaatgtggactttccgctgccgctctcaccaatgattcccagaatctctcctttttcaatcgttaacgatactcgatccactgcattgatcgttccacgatccatctgcttcaaaagcatctctgaagcttctgatccccctcgttctccatgcgcgtttgaacctgctggctttagttgattctttcgtgacggcttgtcaggattccgactgattcgccattttgatctacttttcgaagttgcgtgacgacgaaaccctatagttagctggtctgcttcaagtatcttacccatcgatctcactcctaatccttggattaaaggcatcttctaatccttttgaaaaaagaaagcaggccgactggaaaacaacgatgccaacaatcggtgtaatcaaataaatagcagctgaggatccaaacatggcaccggttttggtcattgccaaattcagcatgattccccaatgctcccctttaaaaggtgccaatccaagcaacatcaagccgacagaagcaagaaccgatgcccgcatgatcaagacaaaattgattgcaatataagggatcagactaggtaaaatatcttgccgaatcatatatcccttagacattcccaaaagccggctagccagaatgtactcacttccccgcaatgtcatgacctgactccgaacgctgcgagctaaccctgcccagttccaaatcgccaaaagaaaaccaaaagccagaacatttcctgcactgatcaccaaagaaagtgccataagtacgggaaaagaaggaatcgtcaaaacaacattcgtgaggaacatcaagagtttatctgttgctcctcccacaaatcccgcaacaatgccaatcgacatcccaatcaaaatcgagaaaaaacctgaaaataaggcaattaggacgacatccctcgttcctaaaataaactgcagcaatgtatctctaccagtaaaatcggttcctaaaggatgttgcaaagaaggacctaataatcgattggtataatctgcgggcaagtcgccaatcagccattgcccaaaaagagcgaaaccaactaaaatcagtaataaatacattccaacagccgcttgacgatttgcacgaatcactttgataaaagaagacaattgtttcattctgtctgcctccttaatcgaggatccaaatagccatatagtgtatctacaatgacattggcaccaactactgtgacaatgatcataaagaacatcccttgcatcaaaggaatatcacgcaccgcaatagctgtgttcaagtaatagcccaatcctggataagaaaagatgttctcaatcaaaggcgcaccgcccaataaaagaccaaaagtcgttcctaatgtagtaatcatgggtaagcgagcattctttccgacatatttcttgcggatcacaccatcactcaacccacgcgcacgtgcatacttgatgtattcttggtgcataacattcatagcacttccccgcatattcagaatccagttcgccaaataaacaacaaaaatggcgctgataggcaatatcccatgacgtgccacactaatgagaaacggaaggttcaaaccaaccatcacttgtgatccataggcaccgcggcttggcagccagacaagctgcacggcaaacaaagagaccaagaagaaaccaatgaggtaatccggaaacgagccaaccatggaggtcagtgtttctgtcaccgtatttaagcgtttatttttgcaccatgcaaccatcaaaccgattcgtgtacccgccatgtaagaaagaatagtcgccacgccagctgaaaaaagcgtccaaggcaatgcacttaaaacaatggataaaacaggcgtccgaaaacgaatcgaagtgcctagatctccttttaagagctgcagaatgaaatggccgatctgctgcagcaatggctgagatggatcataattcagcatactgatcgctcggctcatagcatccgcttctgagattccttgcgtacttcgcagctcatttgccaaaatcgttactggatcgccaggcatgattttgataatcaaaaaagtcataaagacgcctgcggttatcgtaaagaaaacattcgctaatttcttcatttcttatacacgcctccttccagtctatttgtttaatcagtgattcccatgctcttttgcaacgttccttccgcaatcaatgaagaaaacatcgattcgccgacgccaataaagcgtgggtcttgaaccaattggtttgcaggaacttgaaagtcaatagccggattaagaacccgcactggaaagcctttttctagataagggatgaacaagatatgctcatttgtcactgccatcaactctttagtggccgcaataaaatcgtctccctcactgtcaaacagatgattcgttaaagcgatcacatcaactttcccttgagcgttggtcaaatataattctcctgttggctccgtttcaagtccgaatagccaactgcggcccttatataattgttcatacgtcccataaggattggcataaagaatattagaaggcggggcaaattcgatagcaacggtgtgctctccatttctcaaatacgcatcataagaagcgccttccattggcagaaatgtcacatcaaagccaaaactattcaattcattaacgatcgcttctcccggcaataaagctgaaccccagccattattgcaagcaaaatcaaaggccactttatttccttgcgcatcgatccaggtatcttcttttgtccaaccagctgctaataagacggcttccgcttgctcaacattgtattctcgtgcggtgagctccgactgcacccaatctgtcaatccataaacttcttgtaaggaaagcggcaatcctgtactccccgtctcacttggcatactgccgacttctgctaacggaagaatttcatcaggattcaccaaataggccacagcttcgcggaaagccagctcctgggcaaaagcctgctttacattgaaaactacggacatttgtgaatactctggtaaataaaattcagtaaaatggtccaacttactttcaacttggcgaatcaaatcttctgtcataccgccactgtgcatatcgagagtcccatcgatcatactgttggcagctacttcaggtgtgacagcgcgaataatcgttaatgaatcgatgccagtctcttgataaaaatgttcattcttctccaagactgcttcactggtagaaagagcagcaatcgtaaatgcgcccgaaccaaccatatctgtcacttgcggcatatatccttccaattcttcattaaggatttgtaattgttcatttcctgcttctgaataccaatacgtattggtctcatcatgccattcccgctctgcatcagcgatgccttgatattgctgtgcccaatcaccgtattcctcgaaacgagcagctacctttacatcagtcagtagattcagcatcaagtgactttcatttttgaaataaaacgccactgtttgctcatccgggacttcaattttctctaaaaattcccaaatctgtttcttaccgacccacatttggtagctggtgaggacatcttgagcagtgatgtcgctgccatcactccatttgataccttccttcagtgtgatattgatcacattttgatcaatgctgtaactcgaagctagcctaggcttgaaattctcgccgccttcacctactggggtgaatgaaaacaacgcttcttgcacataaggttcaatcccaccaccaataaaaccactaatatagggattgccatgggcagttggcggaacaacataatcgccattgatcactaatgtttgagagtcctgcgctgtttgatcggtctcctttgtttcttctccacaggccgttaagagaaagaatgcacccaagcaaaccagccctttgaattttttcatgtgttcactcctcagctaatatgatccctgttgatccgataacgattgacggattgtctccaatgactatcggatcaaccataggtgaatagaaaccaaggcttgccaacttctggacctaggatagaaggattgttcacccgacgaatgtaacgacttactattcgttcagctatgactacctatttatcagtaagcattatcattacgaggcttttatgcctgccatttgtcaaaaaacgattctgcgcatgaatgtttagacaacaaaaaaaggcatcggacaagactgtccaatgcctttgacatagcaaaataagcgtctagcatcccgcgaaaatttaccaaaaaaacaccccgctactagaaatgaagggaaattttgggtacaataaacacgttgatgccgatggcgttcaactatggcaacttgattggtcatcttggttaaaggtctgactgatcagggcctcgccgctctgcgccaacagagttgcgaggtgcctatttttttggtttctattcggttataagtgtagccgattttggaaggggttgcaagcgaacatcagaggaaaaacgaacaaaacattcaaaatatggcagtattttattgagatatggagattatccttgatatttctattgttttaacaagaatcaaacggatgtacaggacttgctgctcttcttttaagaacacataccacagggcagttactggtctttgttttgttccttctttcgcagtgcttcgtctaataagtaaatcacagtcaaatatttatccttctctttattaaaaggaatacgcaagtaatacccagcaatgagaaccaacaacaaaaacacaggtaatgtgaattctggactttttatttcgaatgtcaaagccaacatagctaagataatcgataacgcagacatcgagtaagacattttgtcatatgatgtaagcagctctttttctgtattagaaaaacgtgtgctccaaaatcgcaaaataaacgcatcttcttccgcaaccctatcaatcagttctactaattctgcttttgtgcgcacttgttttacatgcgtgtataagatatctttcaccacgccgctttgatccttttttgtatagaaatcaaataaaatttctgataaacaatactgagcattgttctttggtctaaacttctttaacatctacttcctcctttggtattataatcgcagcacatcataaatatttaatatcaaactatataattttatcaaaaagttaaactaatttttcattgtctgcaactctatttcattggatttaccgacctaaataatactatgaaaatgttactcctagtatgactctctacacaaaaagagaccaagaatccttccgattctggtctcttacgtcaaaactaatactcacaactcccggtatttctttttggagtccttactttgttccaccggatatttcaccgcatttttctgcagtttctctttgatgatctcatcaacatccagctttagattatccgccagcatataaatgttttcattcctacacttcctccccaacaagcgtcaagaaagcctcttcgagattcttcttattcacttttaatagaatatcagctaccgtcccgctggcaacttctttgcctttgtttaacacgagaatccgatcacacagcgtttccacttcatccatgtaatgagaggtcagaaagatagtgacccccttgtctttcaaagcgagcaagtatcgccaaacctcgcgcctggcctgggggtccagtccggttgtcaattcatccaaaaaaatgatttgcggattccccatgatagccaaaaggatacatagcttctgtttctcgccccccgataatgttccgagaaatgaattcaatttagaggcaagaccaaattcatggagcgcctgcatccagtttagcgggttttcgtacaacgaatgggtgatctcgcaaatctctcttacctttaattgattttgaaaggcagattcttggaattggacccctacatactgaaacagtcgtttccgttcagccttaggatctcttcccaaaagcgagatccttgccgaatcacatttttgtgtgcccaaaatacaatcgatcgtcgtggatttccctgccccgttatgtcctaacaaaccaaagatggtgcccctttcgactgtgaaactaagatcatcaatcactcgtttctccccaaatgttttgctcaatccatgaacctgtatcgctgcttgtttgctcatacattccctcccatctgatctggactcagtttagccgaaaatcaaacaatgatgggatagtggagggaatagaaatttttttctaaacaagtttgcaaattcctaaacatgttcagaacaaagggaaaacacttacatttcaaaagagattctttatactagtttttgaagaaacagtggccacatcgttcttctattcaaaaatagccttcagtgctgcacttagcaaaagctcaaattggttcagtgttgtgccaaagaaaagattcggttggtaatcggagattctttggggagtatatgtttctgtgctaatggtcagtgtggctaggctgccgatttttgaatttttttgaccaacaaaagcaatcacatcgatatggtggtcgttagccattttcgctagctcagctaaccgaactgtatccccagaattagaaataataacgagcagaatatcttgctgcacttgctgtctaagaaattccagatggctattggcagttgcacgaaagccatataaattaagagattccgaaaaataattggcgagattctgagagaaaccggagccaaggatcatgatgcgcttgtcgcgatactcagagagtaaatcgataaatgccgccttttcctcattggagaaagtgcttggcatcgcaatgtccgattggctgttacctagtgcaaaaaccaactcgctataaccggaatagccaattttcttggccatattgatgattgttgctgtagagacataggttgctttagccacatcacgaatcccgattgtttttaatgactgccgattttttttcataaaacgcaagacttctgcttctgaatcattcagttggtatttatctataagcatttcaacatccataagatccacctcaaattttatcaattaggagtattatatcatgacagaaacgaaatttattcaagatccctgggcaaaaatgacgacccgcaacggtttacgcggagatgaagttatctcggcattgcaaaagtcgatccgtcgaggcaaagaaaaagaagcatgtgaatttgcctatgaaatgtatatcacctcgccgcaatttgaagaaaaactctggagaagattactagcgatcagtgttgaagatgtaggtatgggaaatccaatggctgccattatgatcaataacttaaacacgatgcgcaaggaattccaatacaacgaatccgatcgggcaatgtatttcttccatgcgattcgttacttatgtcagtcggaaaaagaccgctcatcagacttactcaagaatattgtgatcaagagtttcgcgatgggctatgttccagaaattcctgatattgccttggataaacatactgtccgcgggcaggaaatgggtcgtggttccgaacacttcttacatgaagccagcaaagtaatcccacaagcaaaagtcactaatgactacaaagaacaatacgaaaaaatcatcgagaactatgatccagatcacgttgtgccaagcgcgttttcattcaatccttggcaagtataggaggaagttacatggaaaactctgcatttatcatgaagctgaatgacgtcctaagccccatcgcagcaaaaatcggcaatcagcgccacttaaaagctatatccagcggtatgatgtttggactaccctttattgttatcggttctttttttctaatctttgccaacccacccatcaacatggatcagtaccatcctgaaacagccaatatctttatgacatttatggctggctggaaagatttcgctgtagcaaattatgatctcatcaccgcgccttatcaattgacgatgggcatcattggttttatcagcgtctttgggattgccttctctcttgcaaatgaatacaaaatcaacccttccatgaatggtatggttgcatccgtcatttttctaatggtttgtacaccagtgaaagaaggcgcgatcagcctcaattttctaggaacgaacggactcttcgtcgcaatcatcatcggcttgttagtggtagaaatcaatcgtttgtttgaagtgaaacagatcaaattgaaactgccaggtaccgttccacccatggtggcaaccttcatcaatatgctcgttccgctgttgacaaatatcatcatcttctatgggatcaatttgatcttcttggcagcaacaaacaaaatctttcctgaagcagtgatggaagttctgactcctgcaacgaacatcgctggcagtctcggcggtttcttgttgatcgtgactttgggcaatatcttatggctgtttggcatcaacggttcttcaatcatctttcccatcgtctttacactgggaatggctcaaactggcttgaatgccgagcaaatggcaaatggcgaaaccatgacacacttaatgaacttacaaatgtttcggatttcagtccttggcggagctggtggtactttgggattggttttattgatgatgcgaagcaaagttcccgaatatcgcaccatcggaaaattgtccttgattcctggaatctgctccatcaacgaaccagtgatctttggcttgccaatcgtttttaatcccattctagcaatcccatttttggtcactccgatcatttcgttattgctgacctactttgctcagagtcttggatggatcggtattggctttatcgttgatccttccttcacaccgttttttgcacaagcttatctttcaagtatggactggcgcaacattctcttttgcctactgttgatcgtcatcagtatcttcatatactatccattctttaaagtaatggagaacaataagacaaaattagtcgatcaaaatctataaccattcttcgtaacaaaaactagaacagctaaatgattttgctttatactaaaaaaaagacaaatcctttcccattcatcgaatcaactcgattcgaatcagaaaaggatttgtcttttttggttaaaactccttcatttaaaagacctgaaaagtcagcacaggtttaggcataatgaaagatttcaaagcggaggccttctggcgtctcaaagaatagtgcataatacttaggcgcgatccgttctttgtattccattggtttcccatgaagaatctttactcctagtgctttgatttttggatagatcgcgtctacggcttccctgctttctgctttaaaagcaatgtgttggagggaaccaggctttctagaatcaattgtctcattgatccattcttgctttggcgaacagatcccaaaatcaaaggtatcactcaaatactctactacttccatgtcggcatgttcgagatagcctgaatatttcttttgaacatcaaaacctaacaaatggaacaattgatcataaaagggttccgctttttttcatcgttgacagtaatttgaatgtggtggatttgatacatcagtggctctcctttcgttataaaccaaaacagttaacagttctcgatagcaaagggtgggtactgaatcgctcttgtcgccaagtgaatgagtttttcctgattgtcgtcagccgcaattcgattcgtctttagagtaccacaatttcggcaacggtgaatgattgcccattcgccatcctccttggaccaaatactgataggatccatcttccctcggcacaaagaagctcggtctccgggaagagtatccgcatgaagactcgttaaacagtggggacagtggttgcgatgctgactacctgcattttcaggatttaccggtcgaccgcattcttcacagataaaactgtcaaaacaattgaaagtaactctaacaatttttaaattgttctatcagtttccttgaaggtggtttacgatcaattttctacatacttagtttatttagtataagaaagtttaaactttacatatatttttcttgtataaggattagttcttcttgtctatgataaaatttattaaacagtttgaaagtaaaaactattcaaagaaagtgggcgataacaatgggattttggtattttttaacgttagctgtcggtataactttgttgatcataagtgtttcaaataaagaagtatctagatcaaccaaattcgtagtagcctgttttgttttagggatcttgttagtcataggtagtctacttttatttttaccaggcagctcttcgattattgagcaactacttcaactaaattagcttcgttattaaaagccgactttctaaaaaaagaaaatcggtttttatttgtactggtcgaaaaaaatttttctacggctggttttgactttattttagatccagctgaacgatcaacggctccccttcttgcattgcttcatccaacattaaagaataaacatcggcatcctctttcgtgatacgtaactgttgcgcactcatttcgccagcacccacttcttgaatacgcatcatttggttctctggatccacgctaagtcctccattctttggtttggcgaattagcggtaaaaaaacgtatctggggtttgaagttaggattcaaaaaaatataagaaaagccccatttaaggggctttccatttaaggggcttttttatctataaaataaagttcagaaaagtctctatcgtgccactttcatacatgatgtatagtccaagtggaatgaatactaagggcacaatgattcgctcgtatttttcaattgtctcggatattaacggaatagaggatagcacccgactaagctcgcaaaagataattatgccgattgcaaacacaagcaacgccacgagggtctgtgaccaatctaacgaagcaaaataaggtatatagatacctaaattatctccgccagacgcaattgtcagcaatgtaactgtccaaaacagttgatttgccttgctttgttctaatctttcaataatttcttcctcttcttcttcctcaccttctccaacaattgcaaagcgaatccctaaatagatagggattaaaccaagcaatccaaccatccatgcttcaggcacgaaattgacgacataagcagcaactaaactcgcccctacaagtaagcctgtgcctagatattgccccgcataaatatgccatttctgtttattctgtgatagctgtgcaaataaaataatcaatataattaaataatcgatactggtggaaatataaacaccgatagcagatatgattgtctgtcccataaaaaaacctcctgtattagtcagtaataaatcagcagattttaggggagcacagacacattaatttagctatcgctagtgggtaatatcgaacgtaggaaagcattttactcctcctcaaaacgtagttacaaagtagtttctaactggaattcggtgactacttgtttgactttcgaatataagcctgcatattttgccaattttgtttgattttccaatcgttcaatttgaccgatttcaacgattaattaagtggagtacacctttccaatacctggaacaccgggcaaatattgatattctcgaatgccgacaaataattgcttgattgcttttccaagtctttgatgttcttttcaagcgcacgaatttcacgtacaagaacacttagaacgacattgctggattcttgtgcaagtctacctaaccgataactcatggtaattgcacgttgaatgatttggcaattttttctggatctttaaagtaaccttttccttcttcttgtattaagtcacagaacgcctctaaggcttctttagctatagtcgctgcatccgcaatatttccatagttactgcaattccttttacggtatcttcacccatgacaaccattctaaaaattttcgctaactcgtccattccagctggaaaagaatcccaaaaatcaatatcataattaccattttaggcttctaaaacaaaactacaccaagaaaggatatcaccatggatcattgtactaaaaaattgggttctatgataaatagtgttggtgaccaatactatttgacacagaaccatttaacttaacttgatgcaaataataacttatctaaatcaaatatctcaacatatttttgagtatgctgtttaattaaacctctctcttccaatgatgagaacttacgacttattgtttctggggttgtacccaagtacgaggctagatcttttttcgacattggtaaagtcacataagtatggttttcttcatcttcaacgtattctgatagaaaatcaataatacgagactctacttgctccataccaacttgcatcgtttgcttttctgatacctgtaaacgtttcgtaacatctgatagtattcttctcataatttctgggtaagcgcctaaatagtcatccatatcctttttatgaattctacatatgctcacttctgatattgcttcagcataattagaatggtaactttcagtttgaaaaatagccacttctcccataaaatcaccaggatttaatatgcgtacagtttgttcacgaccagattcatttaagttataaacacgtacacgcccattatttataatataaagtgtgtcatctttatcaccatttccaaataacaacgcattctttgcataatgtacttcttgcgctgattgcgcaattaaactcatttgttcttcatttaggtgattaaaaattggaactaaacgtatacaatctatatgactatggtggtgatggtgtgccatacaactttcctcctaattaatcgttatctatatagtcatcatcttctaacgcatccttgttaacaaaggcttgaagttgccaaatatttatatctaagtaatctttataactaattagtaaatcttctaatgcatcatctgcttcttcttgtgctaaacgcattgcacgaacggtgaattcacgattagtcctaaaatcttctactaactgtatgaccatttcttcagcagaataatatttttcagacggatcttcagaaattattgtaaattcctgaaattcagtagttgttgaagctggcttaaatcctgaagctagtaaacgttctgcaatcttatcaaaccatgtctcattctcattgtataaattctcaaaaacactatgcaatgaatagaaatttgtgccttttacataccaatgatattgatgtaattttacatgtaaggtatggatattagcaagtatatgatctgtgacagctacagcattaatcttagtatgatgaatgtgttctttatatgctttttcagcagctaatttttcttgtctttcatttgctgttgtcattttatacaccttcctttacttttgaactaataactgaatatcctaggttttcaatagctctttcaattgtactcaaattgacttgttcttcatcaaaatctacttttaccttacttgcattgaacagtatttttacagaatctttttctacaccagctgtctgttttaaaccactttcaattttttgtaaacatgatggacaagttaatgtttctaattttaatgttgctttagtcatatctatcactcctttaaataaattgtacaggacatttcttttaagataattgacatagatcaattatcttaattgatatcttcttaatctcattgcatttaaaataactactaaaatacttgcctcatgaactaacatacctatcgacatagacatccattcactaaatattaaactaaccaataatattatcaccacaccaacagcaattagaatattttgtctcatattcgcatatgtccctttagctaaacctaaagcatgggggagacgattaaaattggaattcattagaacaatatctgaactttcaatagccacatctgtcccatttcccatagcaatccctacttctgcagtagctagagaagggctatcgttcacaccatcaccaataaaagcaataatttcaccagtagactgtctttcttttagaaacgcttgcttgtcctcaggtaacatatcgccatgagcctcggttaatcctagctcctttttaactaaattaactgtgccttgattatcccctgataatacagtgagatttttaacaccaagtgattttaatttttgtaggtcttgtttaacacctgctcgaacttggtcacggattcccattaaaataattaacttacgatcaactgtcgttaatacaatactcttcttttttttcaagaactcaaaaaagcggaaaatcccagatttaaaaatctgagtttccgcttttgtcatttcaaggatggactattgtctcagcctcttctaatttattcttaagatatttttactttctctgcaggtgctgatacttctttttgttcttttcgacctttcaacttatacttcattaatctcatgccattgaaaattaccaccaagatactaccttcatgaaccaacattccgatagacatattcatccattcgctgaagaagacgctggtcaacaagaccaacactactccaattgaaatcacgatattttgcttcatattatttgcggtggcttttactaatcctaatgcgtgaggcaagttgctgaagttcgagttcattaaaacgacatcggatgtttcaatcgctacgtccgttccgcttcccattgcgattccaatgtctgctaaagctaaggacggactatcgttaacgccatctccaacaaaggctacaatttgaccacgttgttgaagttttccgatataagccgatttgtcttccggcaacatgtggccgtgagcttcggtcaaaccaagttcgccggcgaccacatcaacggttccttggttatctcctgaaagaacgactagatttttcacgcccaagtcttttaattcctgcaaattagctttcacacccggacggacttgatcgcgaatgcccatcagtacttttaattcaccgtcgaccgctgtcaaaacgagagagttcccttgttgttcaaaccgtttgacatctttttgcacttttttgctgagagtgacattttctttttccatcaaggccacattcccaacagccactctatgtccagctacacttgaaacgattccgccgcctttcacgacttcagttccttcaacaggataaaaatttgtttctccaatttgatttaagaccgcttttgctaatggatgatctgattcccgttccacactggccagatagccaagcgtttcagcagaatctttttcatacagttcagtcgctgcaacggttgggtttccgacagttaaagtacctgtcttatcaaatacaattgtatccacattgctgaagtcttgaatgacttcactcccttttaaaagaacaccgttacgagcaccattcccgataccggcaacgtttgagacaggcactccgataactaatgcgcctgggcaacctagaaccaagatggtgattgctaactcaatattttgactgaacgcccatacaacaattgccagaaccaagacagctggtgtgtagtatttagaaaagcgatcaatgaaccgttccgcttcggatttagaatcttgtgcttcttccacgagttcaataatttttccaaatgtggtgtcctcaccaactcggtcagctctgatttgaatcgttccgttttctaaaatggttcctgcaaaaacttctgcatcagctagcttgttgaccggaacagcttcccctgtaatgctagcttcattgatatgcccttcgcccgtaaggactgtgccatccactggaactttcgcacccgttttaacgagcaagatatccccttcatctacatcatccacttctacttcttcaaattcgccattatccatttgtttcaaggcgctttcgggtgccatttcagtcaattctttgatagcagatcgcgtttggttcaatgttcgttgttccaagtagtgtccgaataagaataagaacgtgacaatagccgattcttcataattttgaataaaaagcgcaccaatcgctgcaatactgactaagacatcaatactgatgactttgactttcattgcttgaaacgcttgaatggcaattggcgtaatcccaaagacagaggcgatgatcaaagaccactctgaaagtcctacgttttctaaaacaaagtgactgaagaaaccgagtgcgattaacaatccactgatgacggtgataacatttttcttgcttaatatatattgttgcatgctttttccctccaaatttaatttctcttttattgataaacacagtataagataattgcctaagtaattaattgactgacatcaagttttgaaaaaatacgtgtcccttctcactatttttttgatctaacagcctcaatgacacttattcctctttacagttataacgataccctctttttatcgaataaaaatttacggctatcaagtttagaaagttctcttttatcgtttctaagcacctcgaatcggattgcaacaaaaaagcaatcccggaaaaatagcttttcttccagaattgcctagttcatttaatctgttaagcggccttgacttttgctttaaggaccggatagcctacgttttcgatagctttttgaatctcttcaatcgaagtgacagctgaatcaaaattggttttgactttgctggagttgaataatactttaatgctgtctttatcaataccgttaactgatttcaaggcaccttcaattttttgcatacaacttggacaagacaacgtttctaattgcaatatagctttttccataattcctatctcctttatgtgtttttattttatccgcagcagattaatgaacactgccttttcctctttacaactgtagtatagctcacttttagcaaacgaaaattgacgcatatcaagttttgcacttctttttatctttttgctcaattcaccatcttaatagtctttttctgccccttattgccatcagaataataataaattggtggatagtcttgtctgcgtataaaccatactacaatcgcgccaataaacagggccagagacaaggcttgcgaaacgcggatccactcgccaatccataaactgtccgttcgcataccttcaatgaagaaccgacccactgagtaccacaaaacgtaactcaaagcgacttctccttgacgcaaaagctgttttcggttccgtatagtgacgatgaggacaaagcccaacaaactccacaatgactcgtataaaaaagtcggatggtagtaggtaccattgatattcatttgttcaatgataaattcaggtaaataaagattttccaagaattgacgagtaaccggtccaccatgagcttcctgattcataaaattgccccaacgaccaatggactgggctaacaatacattgggcgctaaaatatcaagaacgagtgccaaagaagtaccttttttctttgcataccaatatagcgtaccccctcctgcaatcaatcccccataaatcgcaatgccgccattccaaatcgcaaggatttgtcctggattttgcagataataaccacgttcaaataacacataataaagccgagcgccgaggagtccaatcggaattgcccataaggccatatcgataatggtatcctcttccagtccttttttctttgcttccttggtgctcaactggagagccgctaatatgcccgctgcaataatgactccataccaatgaatcacaacagaaccaatctccaccgcatggggattcaaaacgcctaatacgaattccattctatttgctccatttcttcaatttttcgcgtcattctagtcatggtgatgctgaacaagattccggctaagctccatggaaaccaaacagtaaatacacttttatctccctggtcactcgcttcgtaatacgccacttttccgtgtccgattacgccggctccttttacaacttcctcttctttttccatagctaacctatctgcctcaacaacgttagacgtttttgcttcgccgccaatcgtgttcttggtgaaagggacgacaaagaatgcacccgctgctgacaacgtgatggcaactatcacccaaaaataatgcacattcacccctacttatttttacgttttgttcgacaaccctatcttaaagaaaaataaaacaaaaaaacttgagggttatcatgtttgtgcttttatttttccaatgaatgaaggtcgttctgtcttaaaaaagccaaaaacggacagatggaagcaaaagcactgagttctgtcccgttgttaatgaagagcgacagaacaccaacgtgtagaaaaaagtgtgtccgattattcgctgtaaagcaataaatcatctaaatcctgaatcttgatccttttcccagacagctgttgaatcaatccctcgtcctccaattctccaaatttgcgactgatggtctcaggtgtcgttcctaaataggaagcaatgtcctttttttccatcggcagggtgatggtgggagagttgcccatttcaggttccacattttctgccaaaaacaaaactaaacgggtaatgacactctccaaggctacttgtgtcgtttgacgttctgaactttctaaccgtttagacatttccgccaatagttttaaagaaatagctgggtattgttccagaaaatcttggacatctttttgctgaatcatacagacaacggtatctcgggttgcttcggcatattcctcgtgtactgcatccgggttgaacaaggtccattctccggtgaaatcaccagggttcaagatccgcactagctgctctttgccagagtctgccaatcgataaatacggattttcccacgattgataatatataaagtatcctctttttcttgtgaacgaaacagaaactctcctttttgatactgtttcgtgtgggctttttcagcaatgtaattcatcgcgctatcctctaagtgattgaatattggaaccaagcggatacaggctgcgtggtcgccaatttcatgatgggtatgtttagtcaattcattctccccctttatttattttgtttatattcgctgcttttattatataagtctcttactacaaaaaaattgatgcacatcaagaaaatggaaaaaggactggaaagaattccaatccttaaatcagcttctacttttaccttaatcttcatcctcatcaagagcgtcatcatcttctaatgcttctttaccaatgaacgcttgcagcatccaaatgttcttgtctaagtcatttttaaaagcaatcaatgtatcttctaaagcatcgtcaccctcgtcttgagctaaacgaatcgcgcgaatagttaggtcacgagtgcttctgaagtcctcgataatattttcaaccatgtcttctgctttagcgtatttattaactgcatcttccgaaagcatcgaatatttttcaaattcaaccgttgtcgaagcaggtttatgcccagaagtaattagacgctccgcaagtttgtcgaaccatttttcattttcgttatacaactcttcaaatttttcatgcaacgtaaagaaattggctccttttacataccagtgatattggtgcagtttcacatgtaatgtatgcatgttgcctaaaagatgatccgcaatggccgctgcattaattttcgtatgatgaacatgttccttgtgttcttgttcttcttgcaatctttcttggggtgttctttcttgagtagctttattttcagtcatgatttattcctcctataattttggtttgtttaaaatagctttctttgattcctcctttttctttactgaatttagtataggatagatttccgttaaaaaaattgacgctcatcaagaaaagtatttcttaatagacgccaggcttctctattaaattcaactgaaataatcaaaggaatgaagtcgttccctccaaacaaaaatttcattaaagtagggcctaaaaaaagaatagcaactatactttgtcaagagacctgactgctatttttttgcttgttattcttcaattaccaaatgtcttgccttgcagtatatttaatgctctttctcactagtgttgcatgcaacactagtgagaaagagtattaataagattaacctagaagaataactttactttatttatgtcataccataaataaaaattgaaaagaattttttatttatttttagtagatcgattaataggagttttagcttgggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccttttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcaacggttttccgctttaacggaatatacgttgcgtccatataaatagcagcataacggtcatgaagctcccgccctttaaacgccgttacctcttctgtaaatgattttgttatattggacatgttttggggcgtgtagtgatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctcttaactaacacaaaatcatttattgttaactgtccaattgttataaataattttatctatatttactattcctagtagttcttgttttgctttcagaactagtggggacgaattttccggattaattccacttaattccacccatacttccgaatcagagtcatttaaaccatctcctaataaagagggcaataattgtttttttatagttaagtctatttcaacatcataaagtgccataatatgatgaaccataaaaaattttttttcttctttgacaaaaacatcataaattctgggattggtgtatcgcactatactataacctgtttcttctagaatttctcttgtcaaggtttcagttagtccctcaccaatttcttgactgcctccaggaagatcaaatcttcccctgtaaggtccggcattcttctcaatacacaacaatttattatctttaaaacatactccgtaaactccaaaatgactggtgatatccattaatctatctccttaaataatatttcatcagtataaaaactgtctttgaatactccaaatcccatattacttttgccatataaaacttgaatagcctctagcgctttctggttcctctttacaatcaaattggaaatattataaattgttttttcaggctttggtttagatatctgcacaattacaaaatcaacctttatatttttcgcagcattcaatttcatacaagcttcaccagtagtacctgatcctccaaaaatatctaatattttatctccatcccttaaaaaaattgaaaacacttcttctagtagtgtaactggttttggataatttgttacaacttctttgttaaaaagatcgttaatatattttctagcctcattttgatacattgactccaattcataaaattcatcttctctttctgaattagttgaaattgtatcaatccatgttgaaaatttataattgacgttgtattttgggcttttagaataacacaatatatattcatgctctacagaaatattttcttcgtttaactctgaatgatttcttcttctccaaacaaatgaacacacaaatttgtctttaccaaaaattgaatcaagaatttttatcacattgtacaattggttctgttgcaaagttttaaataaagaataaaatcccttacggtatctatgatttaagctgggattcccaataataccttgatttcagtacagaccgaaaacccgaagagagtgccttcttttcgggttttcttatataatcctagaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagacgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaaccgcgaagataataaccgacagccacaataatcacgtcttcttggaattgttttcctttaaaagggttcatatcttcgttcctcccgggtcattttagttagattttacactaaaaggtcttgatcgaaaaactttgcaacagaaccaaaaaggagatctatcaagcaatctccttcccaataaatctcctcttatataaagttatttatgaacactgatttaagctaagctgccgatatcacaatctcatcatccactaaatcagccttcaagtttttgacatctaagtggtcaaggtaaaaatccgttaccttatcacgaatttgttgttcaattactcgccgtaatggccgcgcacccattgcttcatcatagccttgttccatcagccaatctttggccgctttagttacctcaagtttgatggattttttggctaaagttttttgtacatccgccaacatcaactcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccatagccagcattagaagtagcaataataatcgtatttttgaaattaatgacattgccttgtccatccgttaagcgcccatcatccatcacttgtaacagtaaagttaatacttgtggatcagccttttcaatttcatctaataatacaatggaatatggattacgccgaacccgttcagttagagtattagcattatcttcatagcctacgtatccagccgaggtaccaattaatttcgacacagctgtacgatcagaatattcactcatatctagccgaataatcgcattttcatttccaaacatatctaaggctaattgcttagctaattcagtctttcctacgccagttgggcccacaaacagaaaacttccaatcggctgattaccctctgaaaagcccgcacggttacgccgaattgcttttgctaccatttcaaccgcttcatcttgaccgattaccttacttttcagacgcttatcaagatttttcaagcgctcaatatcattagcgcccatatcagaaactggtataccagttaaacgttcaaccgattgtgccacatcatcaatcgtggcaatgattttttctttttgatccgtttctttaattttttgcttggtttcctcgatcgatttcttgatatcagcggcttttgtaaagtcctccgctttaatggcggcctccttagctgcctctaattttttaagtcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgtttttcgtacagctctttaacaccttgtaatatacgtaaagtgtcagcggccgtcggttcatttatcacaacatcattgaatcgccgtgccaaagccgcatttttcaaaatagtattgcgatattcatcttgagtcgtagccccgattacactcagctcgccacgtgacaaagcaggtttaatgatatcagccaatcctttgccaccatcttcaccaccagtggcacctgtgccgagaatctgatgaatttcatcaaagaatagaataatattaccagctgctttaacttcctctaccagctgtttaatattttcttcaaaagaaccgcgatattgagttcccgcttccaaagacgataaatcaatcgaatagatttctttatcttgaatcgtttctggaactttaccagccacaattgcttgtgccagaccttcgacgactgcagttttacctacaccggcatcaccaactaagattgcattatttttcgttctacgactcaaaatttctgcagtttcttgaatctcattctcacgtccaatcactggatctagtaagccatcacgagcctgttccgtcaaattagtccctaacttttctaaaatccctccttttttaacagcctgtttaccatctttagatacttctattgttttattattttggggtagcttaccagttgctcggtattgagcaaactcatctggtgtcaacgattgtccattaactaaataccgtgcacgctccgaattttgattatccatgcgccgaaataattgattgaaaacatcatccatatcattgttaaaaaaaggatcatttccgtagaaatttgccatattaacacacctccataaaaatttatatgtttaacttagtgaccataatatcctttaaaactacaactgaattgtatcacaatttttatgtatcgctaagtaaagtgcttacagaatcaattagaaataattaggataattttgtttaaacaaaagagaaatcaatttcataaaatgaattgatttccctacaaggttccctatttaatagcccttgataaagaccttgaattgacaagttactttccagaccaattttaatttaagagactaatactcatacgcgtggtgctagttaaatatagacagtaaaaaagcctgacggtttacacttagagcaatctatagtaaagaagtgttaagcgtatcagactaagactttgctttttcgtgggcttcgattgccagaacgtcctttgaaacttcgttcaattcattacctcatttcttttattatttatgatacggattaaatcgtactctttgcccaaaaaaatattgttaataggaacttgatacagattagacagctcatttaaaagagaaaatggaatatcagaactatctttttcatatttggacaacgtttgaaaatgcacatcagcagttttagcggcttctttgctagtgaatccagcattagcgcgcgctgcctttaacgacatagcagattattttggcatattgaagtctacgattgatccgcggtatggcgagatacctaaaaatttaatacctgttaaaaaatatagatagattcctgttttgggagaaattgcttgtggagatactattttagctgaagaatatattgaagaatatattgaagaatatagagaagagatagacgaaaacttgcccactggtgaagtcttttatttaaaaaccaaaggtaatagcatggttcctacaatcccttctgatagttacgtgttgattcgaagacaaccagttgtggaagatggagaaattgcagcagttatagtaaacggcgacactgaagcaactctcaaaaggagttaaaactatatcttatgtaaactaaaatagaaagcaaactaacgatctcgttttaactaaagccttagtttgcttctatttttttgtatcaatcttcgttgaattattttttaatatatctgtcgttgcctcttttagctcatcaaattcaccctgataagtggcaattctaactacaaattctacgacttcctgattttccatttttagtgagtagccgtttagcttgagaaaaacatatgctgctagaaatgcagtacgtttgtttgcattatggaatggatgttttttgatcagatttattaataaaactgctgctttgctaaattcattaggatatagtgcttctccaaaaatatgctgcttaggctgatttacagccatactcaaagcatttttgtcaataacgccaattgtttcctgtggtgaatacttctttatttgaataacatttaattttactatatctttttcacttaaataaatcatctatcaactaattccttaaatgctgcatcatactcagaaagagcctggttcacgtacatatcaatttcaaggtctaaattactttcttctttgacaatagcatccatcattttatcttcatcaataaaaatgatatccccaggtttcaatcctttttgtaataaactctcttttgacagagtaacaactactgagttaccaacttctctaatcttcctttttttaatattcatattatcagctccataaaaaaagtatataccgtgtatccgaattaatcaacatcttaatatttgtttcacaatacttaatatttattttacctatatagaatgaactactgggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttcctggcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccttttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcaacggttttccgctttaacggaatatacgttgcgtccatataaatagcagcataacggtcatgaagctcccgccctttaaacgccgttacctcttctgtaaatgattttgttatattggacatggtttggggcgtgtagtaatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtaactctattctacagaagggacttccttttttctatttacacaaaatattttacactctcctgagttaaactgaatatcattctgtctatataaattttaagatggattaccatacttttgtttgactcattgacaaaaatctaaaaaacttatcctcagcgagattgagtgtcttttaccagacacaaatccctactacagataagttttttatttttttatgcttttaggcttttaggtatatggatatttcagtttttccttactgataagtttctgtccgcaagaattcttcttgctttaatagctcctcgatggaacaatttttttccaatgcttctttgacaaaagcagtggctttttcataaccaatttgcggtgaaagggctgtaatagtccctgtactgttatttacagctttcgaacaagctgtttcattgacggtaatacctgccacacatttatcggcaaaaatttgacacgctttggtcaacagttgacatgattcaaataaattatggaacatcaccggctcaaaagcattcaattccaattctccggaagctgccgcaaaggtgatggcaccgtcatttccaatcacttgaaatgcaatttgactgataacttctggaatgactggattgactttgcccggcatgatcgatgagcctgcttgtcttgctggcaagttgagttcatgaaaaccagttcgcggaccgctggctaagagacgcagatcattggcgcttttgttcaatgtgatggcaatcgtttttaatccacctgaaatcgaggcgaaactgtcggtatgctgtgtactatcaatcaggtcattcgctggccgtaagggtcttggaaaacgtcggttcaattcttgatagaggtattcttgatagcgataggacgcattaagacctgtcccaatggctgtcccacccatatttaaggtcaatagttctgccgataagtggtgcagccgttcacggcaacgcgtcaaactgtgggcatatgcagcgaaactttcccctactgtcattggcaccgcctcttgcagttgggttcgccccatttttgccacgtgctgaaattctttcgctttcatatgccatctgtcaatcaactgtaccagcgcttcatccaattgttcaatatatacaagcaaagccagtttcccagcactaggatagacatcattggtggattggctttgattgacatcgtctaaaggatgaagatattgatattcccctttcttatgccccatcaattctaacccgcgattggcgatcacttcattcacattcatgttggtggatgttcctgctcccccctgaaatgtatcaacaataaattcttcatcccacttgcccatgatgatttcttccgcagcagtcacaatgatttgtgctttttctttggatagcgtgccagattgttgattggctagcgcagctgcggctttgatacgtgctacttgtttgatcatcgtcagatcaactttttgatcagtgaaagcaaaattttcttttgcgcgataactatgaataccataataagccccctcgtatataggtagactgccaattgtatctgattcgatcctcatcatgatttaaacgcccctttttgtattatatgtgataaaatatcacataagagaaaaagacacgagccttttcagccatctctttgttaatccttgaaattgattcctttcactttgaaaaacaaagagaaacagtacaaaaacagaaaagaggaaagtatttggatgaactagataaaaagttgttgaatctgttgcagcaaaatggtcggttatcgatcaaaaagttaagtgaagcgttattcatcactgcacctgctgtttcccaacgaataaaacatttagaagaaaccgagcaattgttgtattatcaagcgacgattgactatgaacaagccggcttgccgatcaaagcatttatccacctgtcgatcgaaccacagcaaaaagcaagtttctatcctttcatacaggcgatccccaatgtgttggaatgtgattgtgtcaccggcccttattcaatgttaatcaaagtcgttttcccttctaccaaatcattggacagctttatcaatgacttgcaaaaattcggtcgaaccaacacccaaatcgttttctcgacgccagttccctctcgaggatatcaattctgaaaacccaaaaagcgcgcttatctcacatagacaggcacgctttttttatatacaggggtcactggtcatcgactggcacttgcaaccctcgtggtccgacattcgttgaaaatacaatgtgggttttggtatccccataaaattgcaaatctgtgataaaccgatccaagacgaccgtatcactaaaataaaccttcaagagcatagaataatctccagtgatacagtcacactcgatcacatttgggatgtctgcgatataggcatagaaggcttctttatctttggcattcactgcgcaatggacatacgctttgatcagataaccaagtttttggtagtcgatcagtgcctgataagaacggatatacccaagggtttcaaggttttgtacccgcacagaaacagatggcgatgaaataaagcattgctctgcgatctgtttgacagtgactcgggcattttgctgcatgatgttcagtatcttgcggtctaagttatccataatcatcccccgttctcattattttctcagtttatcgagaaaacaacagaagcgcaagttgcagattacatcctatgttaaatttcctaacatcaacgctgagataattggaaatagcgataaacaatcatcgccccacaagcaaacagaccacacccaaaaaacatcatgtcaaagccaaaaagactggcgatgattccccacaaaaaagccccacctccataagctacatctaaggctgctgaaaataccgctgtcccttgccctcgctgcgcctcagacaccgattctaatacaatcgtattcatcacaggcaataagccggcataaccgacaccataacaactcgcggccagaagcaagctactgagctgtgtcgtaaatggcaacagacaaaaagaaaccaaaatcaataataaactgccataaatcaatgtagccgtttggattttggcgagcaaacgtggaaatacgacccgtgttgtgaccgtcatgatcgacatgaccgtaaaataatagcctgcgccgataatctcacgttcaagggcatattgtgcaataaacgccaccacgccagaattggcaaagcatatcaaaaaaaggataccgctaggaaacacaaccgctttgatgcgaagcagttctcgtaacgatgatttcgcttcgccagagtgcgtattcctccgtgaaaagggctgttctttcaaaaagaaactcaacaaaaaagctgttccgctcaacaagacggccatccgaaaaagtacaggaaatccataattttctacaacagcaagtcctatcaacgggccgatggcactcggcacagcctgggcgatactgaaataccccaatccgactgctaatttgccttcaggaatcgtatcaactgccatcgtcgctgctgctgtcgcttgcaaactattgcccaccccttgcaagatgcgcagacaaaaaagcatcaatagcccctgcagcagattcaataaactaaaatcaatcaacagaatggctaatcccatacaaagcaagactttgcgtccatatcgatccaatgccacaccgattggcaaacggcaaaacaaagcagatagccccaagacacctacaatggcgccggatactgctttagaaccacctaaagaagcaacatataacggcatagtccccatttgggtcgtgatggctgtcattgctagtaccgtgaccaccatcactaagtaaaaatctttcgaccaaagccgactagagctgttcaccttttccatattgtgcctcgcttctatacagctaattgaaaacgtacttgtgtcaaaaattgctgtgtacgttcttcttgcggatcctcaaaaatttcttctggtgttcccgcttctaccaccacaccatccgccatgaatatcactttatccgcgacttcttgtgcaaattgcatttcatgcgtcacgatgatcatcgtttgcccactatcagccagttgcttcatgacatttaggacatcaccgacaagttctggatcgagcgctgaagtgggttcatcaaacagtaataattctggcgtcaaagccatcgctctggcgatacctacacgttgttgctgtccgccagacagttgactaggatacatcatagctttatctgccaaacccactttttctaaggcagataacgctgctttttctgccagtttttttgggaaacgccgtggtgtgcgtagtccttccgccacattttgcaacacattcatgtggctgaacagctcataggattgaaagaccatcgctgttttgcgggcgatctccaatcgttgggttttgccaatatgtgcgagatcatactggaagtcaccgatagaataactccccgcatcaggctgctccaacaaattcaagcaacgcaaaaaggtcgtttttccagagccgctaggaccaatgatgcatacaacttccccacgttcaatttgtaagccaacattttttaagatgacttgtttatcgaaagacttcttcaatcctttgatttctgcttgcagcatactcccaccctttcttttctatcgctcaaagcgcgatcgtattggcagattgtccttctagcaaaatatctcttgcattgttcaaagctgtttctgcaatttcttgtacagccaattgggtataatacgcaatatgcggggtcaaaagcacatttggcagttgattcagctgttgataataaggattttgatcccacccaactgaaaaataccgttcttcattggcgatagcgtctaatacagcaccagacaaacgcccttgcgcgagtgcggcaatcaacgcatccgtatcaacgattcccccacgtgccgtattgaccagacaactgccaggcttcatctgtgcaaaaacagaggccgaaaatagcccttctgatgcttttgtcagcgggatatggatcgacaagacgtccgatgcagcaatcaaggtctcaaaggacacatattcgacaatccccttcaaccgaggattttcactcctactagtggcaatcacatgtccccccatatgataaatcgcttctgcgactagagcaccgattcgaccagtgcctaacaaaccgactgttacgtcttgtagctcccgaccaatcacagaccgtcgatcaagttttcctttgatcattgctggaatattgcgtaaagccatcaagatcgacatcacagtgtaatggcccaccgatgttgggctataagaagggacattggtgaccgtcaactgatgcttttgcgcccagtcaaaacgaacaccgtcgacccccgttgatttgatcgataactgcttcatccctaaaatatgcaagcgttggtacaggcactcatcttgctgcatagccagactaggatacaaacagatgccgtcgtgccctgctgccaaatggatattctcccaagacaagccctccattacgatcgtcactggtgttttgtggataaattgccaccgttcgatataagcaatttcctcttcacttaccccgtaataaatcaatttcattggcaacacctcctaaatgaccccttcatatgctggcggcatagcgtattccaacgcatcacctaataaagcgatcccttgatcgatctgtgccaatgtcggcttcgtaaaattcagccgaaatgaatgctcatagccttttcccgcaacactcatgatattgcctggaatgaccgcaactttcgcctcatcaaggtaatcatagaaccgctctgcgtccatctcagtcgataggaaacaggtgataaaatagccgcctgttggtttgataaaggtaagcttatccgttggcagtgcctgtaatgcttgcagcatgcgggcatatttctcttgatacaacaaggtcaattgggccacatgaccttcgaaatcatgatgatccatatattcggccaataccacttgccaataaaaattggtgtgggaatcggaggattgcttggccaaaatcaatttttccattacaggaccagcagccatcataaaaccaatccggctgctgggtgccaaaatttttgaaaaagatcccgcataaatgattcgtccttcggtatctaatgttttcatcttagggatcggtgtaccttcatacaacaactcaccgtaaggatcgtcttcaaaaatcagcacatcatattgacatgccaatgcataaatggctttacgtttttccaatggcattgatgtgcctaaagggttttggaaagtggggatcagatacaacattttcactcttgcgtctgttttgaggattgtttctaaagcgtcaagatccattgattctgctgcaagatccatcggtaccggcactggtatcgccccatatcctttgatagcattcaccgcaccggaaaatgtttgctcctcgcataacaccacatcgccttcattacaaaagacttttaccgccaaatccatggcttgggtcgagcccgaaaccaccagcacctcctcttcgttatcgatatttgacaattgacgcaaacgttctttgatcaaggtccgtaagcgcggatacccctctgatgccccatactgcaagaaagactctgggtccgcttcgttatataatttttgcgagatctctttcaatgtagccattggaaatgcttctgtcggtggaaatccgtaagcaaaggaaatagctgctgcagactccatatttttttttgcattctctcttaatggagatgcttctaatgtcatgatacgttgtgcgaattgataggccattctatttcctccctacatagttgttagccggccagctgtgtggtaaagcgggctaaaaaggctttggttcgttcttctttggtttcctcgaatacttgttgcggtgtgccttgttcaacaatatgtccattctccatgaaaactactttgtctgctacttcatacgcgaatttcatttcatgggtcaccaataccatggtcgcaccggcttccgcaatttctctgagcagcgccaatgtctgtcccactagttccgggtccaatgccgaggtaggttcatcaaacaagatgaccttaggattcaacgccaacgcacgggcgatcccgatacgctgttgttgtccacctgacagttggctaggataaaaatcttgtcgttcagacaaaccgacttgatccaacaaagcctctgctgttcgcagggcagtttctttgctttgttttttggtcacgatcaatggcatcatgatattttctttggctgttttattttgaaacaaggcataattttggaaaaccatcgctgtttgccgttgatgggtcaatatttcttttttacttgctttgtgcaatgtggtggtggtttctcccaattgaatcacaccttgatctgctcgttccaaaaaattgagacaacgcaagaaggtcgtttttcccgaaccggaaggccccaataagacgactacttcgcctttagcgacatcaagatcaatcccttttaacacttcttgtttgccgaatcgcttatggatatccgttactttcatcataatgcggccctccttagtttgcgcaacagccgattttccagtaattgtgcccctttttcgatgaccaaactaatcagccaataaatgatcgcaacagccacatacgcttctaaaaaccgataattttgctgggccgtgattttagctgccgcaaaaacatcgacaacactgaccatggaagctaaggccgacgctttaaccaacgagatcagcaaattactgaacatgggcaatgaaatcggccaggcttgcgggagcagcacacgacggatgacttgtaagttcgtcatgccgatcgatttggctgcatcgaactgcccttttttgactgccgcaaatgcgcccctgaaaatctcgctgctattgatagcagacattaaactcaaggcggcgatcgctatccaaaccatgttgaaatctttaaaccgcaaagtccaatgcatcgactccgcccaaatatcaaactgtttagcagaaataagatataacgctaaaatcactaaaaccactgggaccccttttaagaccgtgacaatcacttgcagaactggtgcgaggatcttgatcctatacagacgaatcaaggcgatgatcaacccaaccaccgcgccaatgactagtgcggtcaacgccataaaaagcgtcgtaccaatataatgacttgctgttttcagcgcttcgatcataatagacaattgaaaactcatcgccattcctccctattctgggacgtaatccccatctagatatttttctgataattctttgatcgttccatctgctttcaattcctctaatgctgtattgaccgcatcaataaagtcttggtcagcttctttgttgaacaataagtaggcatctgagttgtggactggttcgctgccgatctctagattttcactaaatgaattgttccaattattgacttgatattctggtgctaacgttgcatcgaccgcacctgaagtgactgcttgtacgatttgctcgttgttgtattccccataaaccaattcaaaagcttcgggattttctgccagataagcctcagccattgctgcttggttagtagcagtcgtcacatagactttttttcctgctaaatcttcgaagctatcgtagaccgtaccggcatctgaatcagagacaatatacgtatcccagaccacatacccaacatccccatagacgaatttttctttccgttcatcattgacttcatattcataggcagccatctggactttattgctttctaaatttgataacgtcgttgggaaatccgctccttcaaaggtaaaggtataatcaagtaatttttcgtcgattgctttaacgacggcgacatcatagccatcatattcaccattttcgtctaaataagcatatggcaatgcttcattcccagtacccaccttgatttctgttgcatcacttgctccactgcttgcagtgtcggcagaactgcttccgcaagcccctaaaaccaaaagtgtcaccaatgtaattgcacctaaaatcgtttttttcatttgaattcctccctttccctctacccaaaattttcctatgttgttttgattttttgctgttttttggtccatgatatcagtggtacttttgctgtttgttgttttgttttcgaaaaactcatccgacgttccagaccggtgaaaacacgttctaagaggaagcttaaggtaataaacaagatcgccgcaccgacatagccttcaagtgtatggaaggtcactgcgcctatcgctcgcgctttgccgacaacatccactaccccaatggtaaaagccagcgatgtgtcttgcagcagtgcaatcgtagttgtaccaaatgcaggtaatgcgacacggacaacttgcggtaaaatcacttgtcgatacatttgtgttttcgtcaatccgcaagcaatactcgcttccttctgtgtgaccggtacacttagaatcgcagcccggaaagtttcagactgaaaggcagcagtatttaatccgtaggtgatatagatgaaaataattttattccatgaggaaacatcgatttgaatcatttgtaataaggcgggtacaccataatacacaacatacagttgaaccaatatcggtgtgcctcgaataaatgaaacgaagactgccgccagttgactcagaaatggcactttttcgacacgaataaatgcaagtaaaatccctaaaagcaatcctgtaatcgacgccactgctactatcatcaacgtaaccggcaaagcacttaaaacctttggaaaatattcccaaactaatttccactgaaaaaattccgacatattgcccctcctttttctgaatattctgattattagacaatattactaatggaaaaaaatttttcaatagattcattactaaaacttcattaattttataaattctcccttttaactaaaaaaagaaagatgcaaacggtatctttctttttaatataagaatataaaatactacccgtggtgctagttaattttttcctagaggaaaatgtctaaacatgttggtaaatcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatatgaagcgcagtttttaccgattctagatcaagtaatcaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaaagatgtgacggaattagcgatttatcaaaaaggaaagcgaattatggttccattaccagtctaaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatacctgcatgatttttttcataaacagtcaaacgtaaataacgtttttgtttcgttttagcataacgattcgcttcatcgagtaaccgttgccctaaccctttgttttgataatctttgagcagatagagccgttgaatctctatagcatctttttcatcattgactttcatataaccaatgagtatttgatgatccttaataccaataaatttactggttgactgtgccaattctactgccaatatttcagttgtcaattgtgtctgtaaatatccttgcatatcaagtggatctgcgccatcgataaacgattcataaaaactgacaacacttacaacttgtaaagcatctagatcatcataatctaaatacgctagtgtgatttgattgttcatctaactcctccttttgacatagtatactataaatcacccgtggtgctagttaattttaatatcctaaagaatatctcaaagttccttcaaaacgtcgttgtgctcgacttaatagaacactgtaagccagtaatatgctttcaaatctactctctagccctttaacagaacgtgagttgaaattttgacaacctaatttttctaaggaagaaaaaacagtctcaactgtttttctttgttttccaagtaagctgtggtctagtttttcagatttatccatgtttttacgtggcggaacggatatagtaatgcccttaagggcaagcttttcatggattttatggctaatatatcctttgtcccctaggatattgggaagattcgcttcttccgataaagtctctaacactttcacgtcatggacacctggattcgtgatttagtaagtaatcggaaagccagtcttagtaacgatcatatgaattttaagaccataaaaataagatttttttgttgagttatagccaactttggctatttgattcaatagttttgcttgtctatttctaactggtttacataataaactaggaaaactatctataattccgactagttcacctttggtgagcttcttgatgaaaaagtatcgaataatcttgatagtgtaagctaagtttgaacttaagcgagtgaatcgactcctactaggaaagtcaccattaggaaataagacggaacaaaccgctctatacgtagctctttggttagtatagccattaattatgccccatataacacaagcaataatcactgtatcgcgttgcttcagttgatcagtatttcttcggtttttaatcttatctggtacacaattgtggtatatgttagaaacagttctcataatttccttgaatgttataaaagtatctgtataatgttcagtatattttgatgaacgcatatgtagtcctcatttcttgggagttttgagactactatatgcgtttttttgttgatttaccaacatgtttagacattttcctctaggaaaaaattaactagcaccacgggtttaataagttttgtaataattactcgacacggtagttcgttagctacgcagccactgatcgttgcatagtttctgacattgttcttatgattcagtaactcttattccgtttgactcctaatagttcatgggcgaagcgcgtccgtctaaaatagttgtttctatcgtttgaacctcattgacaatttttggagaatcttaccattccttttcagcagttaaatgtaaaattctttaatagctacgcttatttttcatccagaatgataacctcccaaatttttccttctatctatatagcatcattttgtgtttcacgtaattgaactagttgagcaaaatcaattaaagattcaatcgacaatccagcatttcgcaagttttttgctagataaatccaatttaaatcattggtagtataatctcggtagccgctctcgtggcggtgaacgggtggtatcacgccaacacgctcataatagcttagtgtatccacacttaaatcaaacatttcagctgcttttttatattcatcgaatctcctcctcattcttcttatttataataaaccatggagttaactctagagaaaccagaagcctcttgtctctatgctaatactatactaaatacctcctcacattccgtagactattaaaatattaagcaatagataaaatcagttaaatgcaacttctcatattctaatgtttattaagtaagaataatgttaaaataaaaaaacgaagagtattcggcgcagtccagaaaaacttccccaagttttctgtgccggtactcttcttagattaatgcatgttgcttaatcagcctacgctatatatttcttttttgcaagtaattacgatgtagaagcaatgcttaggaatcccttacgttttttctatttttacttttgacttcttttaagtgctatactggataagtaccatgaaagtaggtgttcaaatatgaatactaatttttatccagtggaagtttttagttcggactaccgtttatattcatcaaaagcaaaaacaaatttgtatgattttcaatcgagaccacctttgatcacgtcatttgctgtgctaaatttgaaagagttgcacaatattcaactcaaattatttatttacgatattgatatcgaaaaattttctactttagaggaagctaagggagtgtcaataattttgtgtaaatgattcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaaggattcaattaatccagttgctgcactatataaaaaatttcatcatagtttcgccctagtcgttccaaagattcgatgacaaaaatatctttcttccttaaaaaatgaagttctttttgtaattattctcgtgaggtcttcttttaactacataaaattgtaaccactggttttaagagtagtgtatcatcccaaatcatataattaattgactgcgattgttataaaactcacggtaagccatataactagcaataaacgaagaaatcgcagtaactgaaatcaacataaacatcacaacaatttggtaacgaatcgcttgaacaggatcaattcccgcaaaaatcaaccctgacatcatacctggtaggctgacaagtccaaccgtttttgttcggtcaatagaaggagccatgcccgttttgacgctttctcttacaatactcatggacgcttgttttttattggctcccaatgccaatttttccaatacctgttggcgttggtccgtaaattttgaattcaaagaccgataggtcactccaatcgcagtcatggcgttgctggcaatcatgcctgtaattggaactatttgggaaggggaccagtcaatgactcctgaaaaaacaagaatgagtaaggacaaggctgttcctactccaatagccgtcgttgaaattttaaaagagcggttgatcccctcactgcgtgtatgggcgttataagaagcgttgaacacaatgaacaaaaccatcgctaaagtgagaaagttgttatccactcgtaatacgtagctcaatacatatccaataaggaataattgaacgacagcgcgaattcccgcaataaaaatgtcgtttcctaatcccaatttctctttgtaatcaatcaacaaggcaactatcaagaggacagaggataaaagcaaagaaagattactgatttccaaattgtttgtcatttcgattcctccatttttccacctttgatagtaatcagacgagaagcttggtcgatttcttcctggttgtgagtgacggccaacaccgtagtttgttggtctttcatcatgtctcggactaaatcaaggacaatcgctctgttttcttggtccaatgaactggtaacttcatccaggagcaacactttcggttgatacatcaaatttcggaccaatgcaacccgttgtttttcccctcctgatagttccttgacctctttcgataagtaagtttcaggtatttgaactcgttctaataatttttttgcacgttcccgatcaaatccttcttctcttatgcgggcaggaaaagacaagttctcttgaactgtctcatcgaatagagaagcgttttgaaagaaataagagacttcttttctatactccacaggatcgattttttgcagatccgtacctcgataataaatttttccggaagttggagaaagcagcgtaccaattaatttcaaaagggtactttttccacttccagaaggaccagaaaaaacaatcacttcccctttgtttactgtaaaagagatatcttgaaggatttggtttccgtttgcctgaaaaccaaccttctctaattgaaacaatgaatcactcataccacttctctcctttataaaaaagccctgcaccagtggaccatccatacgggtgctgggcttttgtttcatcctagtgtacctcagtgttcgtttggatcgtttttggcgtcttcatgagtagggtgaaccgttccttcaaggtgatctggaccagcataaatggtatacagtctgagcggcttatcaccggtgttttcgatgttgtgccacatgtccgccggaacaaatacggcgtcatcatccatcactttttgttgaacatgtaagttatctttagaaggccccattttacacacgccttctccttcttcaatacggataaattggtcaatgccttcgtgcacttccaaaccgatgtcatcgcccggttgaatggacattacggtgacttgcagtttactgcctgtccaaatggtcgtccggtaattatcatttcctgtggtggcgtcttcaatattaatgatatacggcttcttcccatgatccttgtagtctatttccatcttccattcctcctagtctttgtactgaaacaatgatacctacttcttatttataataattctaattaatggtaccacatctaaaattctatgcaaaaaaattggctttttggagagcgattctaaacaaagaccatataacgcgcaattacaattggtaccccttaatcctcagcacataaaggaaaaaatatggaatcaaaaaataaccgatatgtactctggttatgacttgaatcagggagaatttcagagacgacacatcatactttttagtttacacttgtaaactaactagcgtacactaagcttatgctcactatcaagcgttgtcaatcctttagactcttatcaatttcgaaagaaagtagcaaggttattgattgtgactgtaaaagtggggtgttcctataagcacattaaactatcttctctaatttatcatgctatttaaattctgttttttcatgagaatttttgtccaaaacttgttaaaatgattttaaaaaatacttacatacacaatccccaaaagacactaatgtcatttcagtcaaaaaagataccgcagaaaatttccacctgagattcaatacgatattactctcttgacagccagcttaattccttagttgaatagattattaaagtgcacaaaaaaacaatgcggcgtttgttatattttctggtataagcgacggtgctataaacttttttgcagattaaaaatcatatgaatttaactccagtaataagagattaagtgccaatgcataaatggaggcatgtccagcactatgcgaatgctaaaacatcaatagtacaggaaatcatgaaaagagcgaatagtaataatgcttaaggagagtgtcatgttttcttggtttgttataggaggttatatcaatgaaaaatacagtagataatttgtcgaaaagtaaagttattttaatgtgcggccctgcgggagcaggtaaatcaacactagcaaaaaaatttgaaagtaccgggatgacaatactatcttatgatgaagaatcattcaaacgaggtttgaatgaacatcctttacctcaggaggttttagaagatattaaaacctatcttgatgaaaaactaatttcacttatcatgcaaaacattgatattgttctcgattattcattttggtctagagaaatgagaaatgaatatatttcattattaaagaaatacgacatagaacccaaaatctattatataaagacacctaaggaagttgttatggaacgtattcgaaaaagaaacggaaatcatcaaaatgatatcatattgacggagcaaacagcttccacttattatgatcattttcaacccccaactgatgaagaaggtgaagttatagtagtcgagggatattaatattgtggttttaggcatggaaattgtactagatgataagttttgtcaaattttttgaaagatatacttccaacaaggggataccagcttcaggtgatatcattattgtcatctcagagcagggggtagtattgattcagccggaagaataagtggcgatgcaatgaagacgatgaatgcattattgaaattacaggaaaaaaacttactgaaatacgttatgtttattcttttgacaactctactcaatcatgattatgcaattagacacgttattttttatcatgaatggatatgttcccgtctaccgatagtgctaaaaacgcagtggatatgtttccgagaacgaacatactcaaatgacattcattctgtcctctcaagccacatcgagttggtgggattgataacaagggtggataagtagaggctggaaatggcttgatatagcggtattttgaggattttggagagttgagattatttcttcttccatttctaaatccaatgttacttgttctgattctggttctgttggctcatttgggattaaatccactactagcgttgagttagttaactttgcaatttgttctagtgtttttatggttggatctgattttcctgattctattcgtgaataatttgatctactcatttctaattcttgggagaatttttcttttgatttggtacctctcatcttttttaagttttctctaatgctagttccaagtttctccccctgtttatgtaaatattttgcacgttttccatttaattatatcgttacaccttgtaaatcacaagtgattaatcacaaatcacttgtgattagtgattttagcttttatcttaatttatcaactgtttagaatattaagtatgctatactaattaacggcaacttgccccgtaagggggtgctattcatggaacaaattatctcgttagttatcgcaccacttttagtgggtctaataatcacattagtggatcattggttagatgattagacgatagcaagcaagttgctgtctaactcacacgcttgtattcgcaacaagtgcaaagaaaagcccgacctactcgcaataggttgggcttttgtgctattcattagaacttatctcgtttcgcacattcattatagcatgattttaaaatgaagccaagttgctgattctatctgttgttattggtgttgcctagaacgattctaagcacatgtttaattttaaagtgggcaattttatctttaaaatgtcctacaatgattcaataaaagcatggctgctagtgaaacttgcgaccatgcttttaaatttacttaaattctctttttaaaaatgattcctgatcctaataccattaatgaacctaggacagacaatgcaatatttgctgtttcacctgtttttggtaaaactttcatttttccgtctaaacctttaactgtaactgttccgtctttttgaacgtctgctccaatttctttagcttcaactttttttgttgttcctatattcaaaaatcatttgacgattaattattttttaggtagcgtatgtttcaataaaccaattgagtctatcgttaataagctaaataatcagcctatagaatagcaagaatggaaaaactaacatgaaaaattttacgaagagtcaatttttttgactcatctaaaataatttacatattatctccaccaaaaaacatagctattaccggcataacgataaggaagattggaattaagcaaattcctgtaagccaaaacttctttgattttttataaattccataaataattatggctaagggtataaaccaaactgcaaaaaaataaattgtgtatgagagcataagtctcttcctccttttaaacaaaggtatcatgacaaaaaatttaactctataagaatttcaattctttaaacctttttaataaaaaatagtgtttaaaaaaatacttattagatactttatctcatttttataatttttacaaacactcttaatattgaatttaattagacaattctagtagaaaagtatctttcatgcagcactattcaaacaattttcgcaacttctttttttatcttcatttcttcattgtgtaaagggccacgataaaatgtaggaaaagggccatcgaaaatgtaggttagatttaaaatctgatattctttttcatgaaaccattcaaggagagtgactcatgcgaaaagatgtcttagaaggagtcttacgacacattatgaacgatattcaacctaactatgcagccatggccaagcaatataattgtgattaccgaacagtcaagcgttactatgaagctggaactaaatgggaagtagaacagatcaaaaagagacaatcttctgctcctcttttattaagcggttttgaagaaattattaaagataaaatggagttaagctgttccgcttcttcaatttattattttattaagaaaaaaggatatcaaggtggctataccaccgtcaaacgatattgtcggaactatcgagaaaagcgtgtaaaaaaagcaaccattcgaattgaaacgacgccaggtctttctgctcaagtcgattggaaagaaaatattaagatggtgagtaaacatggtgaagtcttttacttcaatctttttctatatattctaggctattctcgcatgaaaaacttagaggtaacctttgatcgaacccaagcgaatgtcttcaattgtttggtcaatgcgtttgagtactgcgggaatggtgttcctcaagaaatttggtttgacaatatgaaaacagttgttgatagaagtaaaagccaatttagtcaaaccgtttttaccgaaaatttcgtcaatttgctaaagatgctggattcaatccgattgcttgtcgcccttttcgtccacaaaccaaaggcaaagttgaagctttagctcgtactgttaaccgcttaatggtctttaactacgagtttgaaaatgagcaggagctaaaacgaatcgtctatgagtttatgaatgacttaaataatgaacgttctcaagcagtgaataatcatccctctaagcttcttatagatgaacaatcggtgttgcgtcctttcaatcgtttagaattagtcagatatgtttctagaacccaacacgtaattagaaaagtttccattgaatccatggtccaatatcaaaactcaaagtattctgttcccgtgaaatatattggtaaagaggtaactttagatgtccgtaaggacagtctattcatttggtatggccatcaatgtattcgctcgcacccattaagcaaaaaaaccttaaattatcaacgtgatgactctcttgagattcttcgatctgatgtcttcaaatacttagaagacgaagagttggagcgctttgtagaagaaaatttagatgcttacgatgaattataaggaggctcatatgtcaaattaccatcagttattaaatcaattatcagatttaaatcttacctgtatcaaagaaattttacctgcccatttagatgaagtagctaaaaatgaacaatctctagttgattctttatttgaattaacacatcaagaaattagctatcgtagaaaggagacccaaagaaaaattttaaaacgggcaatgtttccctatcataaacgccttcatgatttttaactttgattttcaacccaaaatcaaaaaaagtgaaattcaagatttagtgacattacgctttttagacacgtatgacaaccttttattcattggaaatagcggtgttggaaaaacccatttagccgtttcaattggtttagagtgtattgatagagggcagagctgtttatttatcactagtacagaactggttaatcgacttatccgggcacataaacgtgggacaagtgataccatgctcaaaaaatatgcgagctattctgtattaattattgatgaagtcgggtatctccccttctcaaaagaaggatctaacttactgtttcaactaattaatatgcgatacgaaagaaaatcaacgattattacaacgaatattcctctgtctcaatggtccgaaatttttggtaataagaaattgactaatgctttattggaccgattggtccatcattctaaaattattcaaattacaggaccttcctatcgaatgaaaagttatagtgaaacgaaaggaaaagaaacgaaacgataaagagaaaactacctacaatttcaatggcccaaaaccaacattttattatggcccttgacaactggcaaaccatacaacttttaaacaactggcaacaacgtcaaaaaaaggagctttctatactaggtttaagccatcagagtaataagcaactagtcttccccaatcgttcaaataacttttgtcgtcctagtcaaccaaatgattggtatgatatgatcgctaataaatataaacttgaaaaacggataactcttcatgaatttagaaaaactcacgtttccttgtgcgcaatggcagatatgaaactagaggatattatgtatcgtgttggacatagagattcaaaaatgacaaaacaagtctacaactatttttatccagaacgagaagaacgaagtgctgataaatttgctcaatttattgagcaagaaaaagatttgttttaatcattttcataaattttggatacaaaataggctagtatcactgaacaaagtaatactagcctatttgtctcatcaaatttctaccaactcaacgagaacaaactaccaaaatggtatgcttacctatttttcttttgatgcactaacttattgcttgtagtaaactagttaaaacaaaaaacatttcaaggagtgatttaatgtcccaattgaatcaaacatacgaaaattatttacaacaaccagaagcgttatcttttactgaaatgaccactatctatcaagaaatattgaaaaatgctgatatgaatgataatgattttatcgggatttgggaagagctgatgggtgctgctattcgttatacagtcattcgtgcagaatggcctcaattttctagggaacaaaaactggcaaaagattccgaacgaacgaatattcacaataccattatcgaccatttcatcctattggaacgcatctttcaattaaaccattgggacagtcattcttggacatcacgcttattcttacaagaagaacaagaacaacgtacaagaagtgatgtgaatgaccaccgacaacggattggcgatttcgcgaattatttggtgtttgtttcagcggttaatggacgatagatatgaaagtcacgatttgataaattctcatcatagtagattatcaatatttttttctaacgtctactatgatgggagcatatcatttgattatcagttcttatacattttctttaatagctttttacgtctgttttttatttgttccatcattaaattctccgtcagaggagatatttgatcaaatttcttttgacatcttctagcataggaaatgaagtttccaaatttactccctttactatcccttacacccacatcaaaaaaatatctataaatatgccttttaccaattagataactcgagttctcaaattcccctacaccaactaagcttggctcacctagggctttgcttgcaaatgtaagttcaacaggtgtctcatctaacacatatcctctaggcgcttttgtctcaataaattgataatctcctggtgccagattttttaccaatacaacccccttatcatccgatacaagattttgtataaccgtttttccttctttatcgatgagcttgaattttgcgccaggcaatgggttttctttactatctgttttcaccaattgtgctgattcttgataattcacaaaaccttcacttgcaatacctacttcaggttgtccctctgttgagtcatttatagtgaaatctttaaccgatagataattggctacttttgactagtgccatgattgacatggtattggaaagatattcaacatatactaacaaaaacagaaaacgattatttaactgaatttctgattacaatttcatgttttacaatcttagattctacgtttccgcctttttcaacaagttgaatcaacatgtcaattgcctcactccccatttcatgaaaaggttgagatactgttgttaaagctggtgtactcattcttgctgttaatgaattatcatagccgatcactgacaattcctcaggaattttaatcccagcttcagaacaagctgacatgacacccaatgctgtttcatcactggcactaacaattccatcatagcaaacacccgattgaataatttcctccatattcttctttccagaatcaaaaccataatctccaaaataaatatctgtatcagaataaatcaattgatgatggatcaacgtttttttaaatccttttatccgtgccttccctgcgatacgatcagatggatttacaccaatcagagctagtttttgacttccacgcttgattaaatatgaagtagcatcggcaatcgcctgttcatcattgactttaacaaacggaatatcccccttcaccgtatctgcagaaagcaacacacaaggaatattgtgttttttaattaaatggatctcatcatttgataaatctacagaaaaaatgataaacccgtcaacatttctctccttcataagcgtgatgctttctttcatcctagacccatctacgcctgcatgtgtcaaaataacgttatagcctctttgataggcttcatcttcaatcccgctaataatatcaccataaaaagtagtagcatactgcggcataataatacctaacaaatttgactttctactcaccaatgatacagcagatttattctgactatagcccaactcatgagtaatagctaaaattttttgttttgtttcctcgctgtatccaccaagaccattaataactcgtgaaactgtagctatcgagacattcgctctcttggcaatgtctttaattgtatattgcatagaaacctcctgagtaaacgcttacgttgttagctctagtattacacaaatatgagggaaatgcgagaggttttagtataaaaaaagaacctcgcgccttcattagtgaaataaatgaagcacacgggttcacaataaattttcttgttcaacgtttgaacatgcgccttctgcgggttgatcttctgtcgttcatcctttttgcttaaagtaaagcatgtcccaatactctaacgagggaacagtgatcgtaacgaaatttccttgcgcatcatgtccatattccatatccagttctttagaaacggaattatatctcggatctggggaagtgagccaagcactttcaaatgtgtcattcgtataatatttcactgtcaaatcttcaacaatagtaggtgtttctttctctccttgatttgctcgccaatcattatcagaaacgccaagtaaattgatcatttgaatcgtatcgaatccactaccagacttactatatgcccagattgtattaggctgtccatcgctcgattgattttgatcgacaaattcaatctgatgcccattatcttctaatccatcccgcaaaagattttgataagcaacaataaaattttgcagcgctttttgacgtactttgtgttcatctgacatatataaattatgcttgggaaaatattcattcgatagcattgcgtcgccatcacctaattcaatacgtgaacctcctgcagcatatactgccgcatctgttaataaaactgcagacatattaaaaggttcactcaccacactctcagcataatcgtattccatatatgctggaatgatcagagatttcccatcactttggtctcgagaattatcgatgacgttctttagactttgataagtattgtactgctctccatcacttgttgtatcccaaggccagatttctgcatataggacatccacagcagaggcatttacctgttcgataccttgagcacctacaggattaaatgatagataatagctatcaagcttctctttggcaatatccaagaattctttatacccatccttcacataaataccttgtgtctcatcaccaatcatatcatgagtccacatttttccccattcacccactgtatctccatgccaaccatcaaatcccatcacttgtagagcttctaaatttttttgaataatatagttttgccattctggattttgaatatcaaagaaaaagagattggattgacctgtaggacttgcacccattgagaatgtaaatcgatcacctttatttttaccagcttcatgatcttctgcataccacagcccccactcttctttgataccatattgagcataattatttgtcgcagcataaatcatattataggacatatttgtcatccctcttgcttttgcttcagctatgtagcttttgatggtctctccactaatcttgcgaccagcccaatcttgccacttcattgttccatcttcaggaattaattgatgatgcaggtatttccaatcatagtattcaatcccatttaattgccagtcgttcatttgctcaatcactgcttcaatgtctatatccttatcgaaatttgtcaaaaagccatatctaggaaacttcgtccatgtgcttgacacatctgctgctgtattcatgtgtcgaatagcgtgaccctctgaatcgagtatgtccaattcaaataaatagcctttaaagtcttcgtttggtgcagtccattcaatttcctcttgaatgctcccttctgatgtcgtttcccaaacgccttcaatcgtatcgattgtttcgttcaagtatttcacgttgacaagatacttgcctttagatgtttctagagaatttgaacttgtcgataacgccaagatgatggtttccccgggatcatacatagatttatctactgaaaactttaatgttgcatcatattgaatgcccaccatctcctcttgcaattttttgttcatataagcactaccaaaaataaaaacgaaaagaaaggcaatgataataatcgaaacagtccagcttttttgtgtatctttttttgttgcaagaacttttctattatttttttctcttattttcgtcatatttactccttttctaaatatttcagtcactaagtaaatcagcttatttctaagacaacagcttcataggggtccaaatagagcataccttttgtatattctttcttcgtataattctgaatcaaaactgattttggctcttcctttagatcaaaagtagttgtcttttcttgaaaattagtaatgatcaaccatttttgctcatctagcacacggcaataagcaaaaatattttcgtcttcggtatcaaccaaattataagttccccaaactacaattggatgttcatgtcgcaattggattaattttttatatgtgtagaaaagggaatctttttcctcaagagctttctccacattgatttcaggataattaggatttatatgtagccaaggtttattcgaggtaaatcctgcattttttgaatcattccactgcatcggtgtccttgcgttatctctcccttttgcattgatcgagtccaaaatatcctcttttgcatagccctgcgacaagcggacattgtacatattgatactctcaatgtcatcgacttcttcaatggtttcaaccggataattgatcataccgatttcttctccctgataaatatacggggttccctttaataaatgcagcaaaattgcaaacatttttccactttggacgcgaaactctttatcattcccccagcgagaaatgattcttggtaaatcatggttattccaaaataaactattccatccctcggaagccagctctgtttgccacttggaaaaaacgtcctttagtgctggaatagacaggtcgattaaatcccacttttcttttcctggttgctgatcaagaccggaatgctcaaattggaaaaccattgacagttcattacgattgggtttggaatataatttagcaatttctggtgttgctccccaagtctctccaaccgtcataagatctttgttgccaaatgtagctcgattcatttcttgcaagtattcatgcagtttaggcccattccctgttatctttttgaatggttgtttaccaactaaatcaataacgtccattcggaatccgccaatccctttttcaatccaaaaattcatcatgtcataaacagactgtcttacttcttgattctcccagtttaaatccggctgttttttactgaataagtgtaaataatactgtcccgttaattcactatattcccaagctggaccagaaaatgttgaacctaaatcattgggcggattcccttgtgaatcaggatctgaccaaatgtaaaaatctctatattgattgtctcttgactgtctcgcctcaacaaaccagggatgttcatcactggtatgattaacaaccaagtccataacgattcggatattccgcttcatagcttctgcaatcagaatttccatgtcttccattgttccgaattcgtccattatctcttgataatctgaaatgtcataaccattatcatcatttggcgatttatagacaggacttaaccatatcgcatcaatgcctaaatacgccaagtaatccaatcgttggataatcccttttaaatcacctatgccatccccgttactatcttgaaaactacgaggatacacctgatatacgactgctttttgccaccatgaactcatattgaatctccttttacatttcatactttttaaatacacttaacattaaaaatgattttaagaatacaagaaaactacacccaataaaaatgctcagatacaacacaaaaacaaatgcaattggggaggtcactatcaaaaatagcaagaacaatgtgataactgataacaaaaagctcacccgcatatttgctaagacaagcctcatagagttcatgaaaacaagcttagccgaatctttaaagcgtgcaatataaccatacgtatattgactacttaacacaaggacaagacccacgatagataccccaagcaagccaatgagattttgctgatccaaatggatcatataattcaaatcgacaaccacaacgaaaaaaacaatagattgcatgatactaaaaccaatagcttgtttgaaatttcgtttatatgccaaaataaagttttcaataacacgtgtatcattgttttcatgcaacttaaagcaaacggcataagctgcgctggttgcaacaccaattgttacaattgggatactccctattaaaatacataaattgagaacgaacagactccacaacttcatcaaaaggttatagacgggtccatctattcgaaaaaaagaattcataggtttacttcccttcttcttaggttcttatcgaatccattgacttgtttttcaattatctcatgattagaattattcttttacagccccaacaacaattccctgtacaaaatatttctgtaaaaaaggataaatcactaacaaggggacaatcgctacaatgattttcgctgcattcagattacgatctgaaacagctaataaactttgtaattgttctgatgtcatgccgcttgcattttgcaaagtttctgcaatattgacagacagagattgaatgtacgtcattaatgggtaattttcaatttttgtcatataaatcaaaccaccaaagaaatcattccagctcccgacaatactaaataatgatacagttgccaaagaaggtaaagatatgggaatgtatatcttacgcagaacatcaaatgcatttgctccgtctaataatgcagactcttccaaagatttaggtacccctcgaaaaaaattcatgactaaaatgacactgccaataggcacagcacccggtaatattaacgcccagatactattgatcattcccagattacgcacaatcaagtaggtcggtatcatcccgccattaaagagcatcgcaaaaaccataaatcccataaagaaacgtctagtccgaaacactttttttgattttgataatgggtaagctaaggtgacgatcatcactaaattaaggaccaaagcaacaaatacacgaaaaacagagatcccaaacgaacgccaaaactgcgtatcgttaatgattctttcatatgctgcccacgtgagatctactggccaaagtcctactttattccctgcagctgcttgggaggaacttagggacagcgccagaacgtttaataaagggaccaaacaagatagtgttaataaaataacgattaaataaatcacaaattgtcgaataccgaatttctctctcatttttttctcctctctatgaattaaaacataacccgatttgtggctttttcagctgttttattcgagacataaatcaaaatcaaaccgataatcgaccggacaagtcctactgcagcccctaaactataatcacgtccgattaacccaattctataaatgtaagtatccaaaacatctccactagcatagactggtggtgaatataagttgtaaacttgatcaaatccggcacttaagatacctggtaaagccaagatggtcatcaaaataataaaagacatcatgcctggaatcgtcacatgttttacacgttgcaaccaactagcgccatccattgttgcagcctcatataaccctggatcaatcgatgtgattgccgctaagaaaataatagagttataaccaaatcctttccatacatctgtccaaatcaacaaatgtggaaacacagcattgctgcccaaaaagttaattcggtccaagcctaagctttgtaacacttgattcacagtaccatctaaattaaatagattgagaataactgatgccaagatgacccatgataagaagtgtggcaaataaacgattgtttgcatggttttcttcatccatttgacgcgaatctcattcaataaaatggcaaagataatcggaataatggtgttcaacacaattttccctactgcgataaaaaccgtattgtaggttacttgccagatatcaggcaaattaaaaatatagataaaattatctagtccaacaaaatccgaacccaaaaagccacgcgctggaacaaaatcttgaaatgccataattaaaccaaacattggcgcatacgagaagattagtagaaaaatcattcccggcgcaatcattgctagaaataaccactgatctttagaaaaccacttcttttttgttgcaagcttttccataaactttctccttatttgataattgataatatagtagagcatttgcagcaatgaacaaatgctctacccaaaatttagaaatgacctttattcatccgcgagcttttgcatttcttctaaaatcgcttgtccaccctgactattccaagtcttcacatatgaatcaaaattatccaaagattcttcccctgtcacaaatttgataaacgtctcttcttctaattttgaaatttgggcaccattccgctcacttgctttaatggtttcaaatgtcgtaaatggcgtgatttcattatagatattctcttcccgtacaccgttcatcacattagttacagccaataatctcgacgcatagaccgcccaatctgttggatctgcagtgctcgggtcatcaagataggttttaattttttgtgcattgttttttactgtgaaacttgaaatatcatcaatatctatctcaccttcagccgcttgagaagcttccactgcatcagatatttcacttaagttttcgaacatttcaatattcattggacgtactgatccgtctacagatttttgcgcataggcatatatttcaggatactctgtttccatatcggttgagtttggtacttcatcaaacaataaattgattatttttatggctaattctgggtttgcaaaatttttattaacaactacatagccacctacacctggtttgctcacaccatttacttgaccatcactactctcaattgcataaggcgtgaatgctgcatcagggtttgcagtttttgcttgaaccaaagcccaatcagataagtgccaagggccaggtataataccaagttctccattaatcatcatcgcattgatgtcgtcgtatgttcgcgtaccaaattgatcatctaaaattccatcgtcaaatagttgttttacgtagctcaatccttctttggttttggcagtatttgacccgtaaaccaactgaccatcttccccaactaaataatttttaggaaatgaatcaaaggcattgaatatcgcagttgctgtatacccagatcctccatgactatcggaagttagccaattggcaaatgcgagaccttgtgttttccctgttcctcctgcatctttgtctttgaacgttttggccgttgattctagctcttccaaagtaatggcatgattgccatcttcgtccaattggacatccaagtcatctaaccaatcttgtctaatccaaaccaaattaggaccaaaatcattcgcagtgcctggtagtcccataattcgatcgcctattttagcagaatcaatttggacattgtcaaaagaattgtaaatatttttgatattatcactagcgtattcttcataaacatctgttaaatcagcaatcaaatcattgtcagccaattcctccatctcatctctgctgacaaccattacatctggtagatcgcctgaagcaatggcaagcgacacttgtctggtataatcatcaccatttgcctcaaatgcactctcaatactcacacctagctcttcttttatcagtcttctataagcattatctgcataagagtctccatcagggagtttggagtttggctgcgtctgttgacccactgtcatgacaatatttccatcggtatctgtttttgcttctttgtcttgttcgccactgcatgctgcaagtaagacaacactactcaatacaactgaaccggtcaaaattttatgcatctttttcattcgtaatactccttttattcggtctacgtaatcgtttacataaataactaaaaaaaatgagaaaatactactaacaaaacaacgtaaacgtttactctataatagtatcattgtctatacgaacttgtcaatagcgctttcatttttttgtttattacagatatatatctatatcggtatcactagttaaaaatatagtgatttagagactccatcatctcctgtcaagggcagtttaaaattgtgggtttgggggtgcggatgtttttctggaccatttttaaaaatacatctttgtttcttccgatattgaagaggacttagtcctcctaaagttaacttgatccgtttatgattataccagtggatatagttatccaattggtttataaactgattgattgttgtgtttttccagtcacgttgataaaacacctcgttttttaatcgtccaaagaaaccttcatacactaagttatctggtgagcacccctttttagacatggagcgagtcaagtttgctttgttcattcgctcgatccaatctggtcatcgataatgagccccacgttcagaatgaatgattggacgctcttgaccttgaagggtagagctcagctcgtccacaatatagcatagtactcactaattctgcgtcaggatttgtttcaatggtccaactaataaaagctccatcgtagcaatcgacaagcgggaacaaatagattttccctttaggaattttaaactcagtaatatctattaactatttttcatttggtttttttgctttgaagttacgattcattagatttggttgtacaggagaaatcttctgagcatacgaatggttcgtgcgtaatattggccatattcaaaataataatccacggctattcgtttttgttcttcagaatactttgatttttccggtgattatgatgaagcttcccagataacaaatattcattataccattgacgtagtgcaccaacggacggatagcttaatttccaaatgatagcagcataagaacaatgatattttatattttcaatcttaaaaaaagtatcttatctttatttcccctatacattttcgttttcctctgaaaggttttcattacttagattatttttaccataacaatctaactatccatttctcattggtgttaattttgatgttactttctacacacccaaacaaaaaaagccagaaacgccttcaaataggcatttctagcttaaacaattctattaccccacagacccttccatatagattttcaaattacacactagtttaagataaaacaaacaaggaaaaacttaccatttactcaaaaaattaactcatataagtacattagaatgtaaaatagactggtcaaaatctggtcaaaaaagtagatgtgacacaagttcgcattcaaagcgatgatccatgatttcgtaatggtcaattatatggatcaaagccacgcgacaagagcgcaatggatgtctctaccgattggttgaataaacgaaataaatagaatgtgaaaaaggatcggacaaatgttcctgtttgctcgatccttttttatttgaattcattttcgctttatcaaacatcatttgattactcagttaaatacttttgacatgagtaccaatgaaacatttattcattaaaattacttatttcttatcgcctttctagccaatgccaatccgccgattattccagcactatcacctaattcgggcgtaacaatgtagctagcaattggtggtatttcaacatatccatttataagctcaacaaatttatcctgaacttttttcttcatgtgttcttgtttcattacaccaccgccaaaaataattctatctggcgaaagcatcagtgttgtattgtatgcacattgggcaaggtaaaaggcttcaatctgccaaaacgaatcgtcagccaataaattctggccttttacacccaaccgtttttcattcgctggtcctgctgccatcccctctaaacagtcttggtggaagggacagtttcctgaaaaaatgtcctttggatgtcgcttgatcaacatatgccccatttccggatgactgaacccttccacgaaagtcccattgaacaaggcaccacctccgatacctgttcccacagtgaagtatgcaacacctgctaaccctttgccagaaccagcaacatattcaccatagcaagccgcattaacatctgttgtccattcaatcggaatattgaaatgttgctttagcgttcctacaaaattgaaattctgccaagcaagtttcggtgttgatgtgatatgaccgtatttctttgatttacgttgaatatcaattggaccaaaacagccgaccccgattcctgccaattgttccttaaaaggtttaaaaaaatcaatgacctgcttcattgtttcaactggagtcgttgtgggaaaactgactctttccaaaatcgtcaattcctcagtactcactgcacaaataaatttagaccctccagcttcaattgccccatatatcatcataggcttctcccttcgaatatgtgtaaaacacttcattaacgcggcaagcgttctcgatcagtgaaatgacgtttagtatttcctgtggacgtcccaactcatcgtacttatgaaaggcccacgccccgccaaaataatcttctgaacctgttgaggttacggtcggatactcactatccccatcaatgtagaatttaaactcgccttcgccccaccaataacgttctaggcaggtaagcgcaaggtaagtacccacgtaatagccttgaccctttaatcgatcaattaacttataatcctcctgtaatttggtaatgcgttcccgatgccaaataatggttgaaggatttccctgccccattttttcagaagtcggtcctagacttattgattgtccaagaaactttctttacgtccacttcattcgggctttaacacaagcacacccaaccttctttgtagctgagaatgtaaagggcatgatgaccttagggaaaggagaagttttaaagcaaataatagaagattttacttctgccagttatacagttacaccacatcttgtaaatgcaagagattagggcgtaccacaattacgagaacgcgtatttctaattggtttcataaagaaaaaatcgaaaatagatttagttatcattacacggaacctgaaccatcccacggtgatatttcgtatataaatctttttaataataaaaaaccttatgtaactttgaaagacgctattgggatctagagtctgatccaggagacttttttgaaggagattactaaactatttatatgagtcgtaatagaaaaaatgtgggatgagcaatcattcaccatacaagcttctgggagacaagctccataacatccaagtggggaaatgatgacaaagttagagaaaaacaaatggagagttaacggagaaattaatcataggctttcggttaaagaaatagcacgcattcaaacttttactgattggtttcagttttctgctggaggaagtttaaaattaagtaaaatggtaggttggataaaatttacaaacaaataggaaatgctgttccagttcttttagcgaaagcaatgacataaccaattgctgattttgtgtccactaatgtattgggggaagtaatgagaactaatattattgatgctatgataaacatagttcattcaggagtttatagcctacaagaatcatatatcagagcaagccgggcaacttctatgggtgatgctttagataaatatgtgactgatagcttctgtggagccatcggggagtcagatgaatttgtgaggttaaaaaataaaagaggtattttcttacctagggaacgactcctgctccaccggatgcaatgttaagaggtggagcaggagtcgagataaagaagatacaatccagaggctcttcattacaattgaacagttcccatcataaatctaaattatatgcgactgatccattgattactagtcacgatcgagttatcttgcgattgccgattcgacaaaggacgcaccagttttttccaagcttcaattttctttcgtttctgataattaaggtttttgactttacgtaaaaatgtgatattctcggttttcgtcattgtaaattcatgctttattgattgtgcaggaacttcaataattcatgaaattggtcaatgacgtgtttttattttgtgaagtggctaagttcattataaaatccgccattcttttattttcgtattttaacttcggatatctttcttttcatttcctattctatccacgcagtgactgggaaatgatcagaaggatagcgaccattgatacaatcagtgacaatttccgttctaagaagtctcatcgccggatttatccaaatgtaatcgattcttgacatcgttgaccaattgatatcattacaaaatttattagtacctgtgcaggttacaaaagggccaatatgatagggtgagttaatcagcgtatcttttaaagtctgtgaaaactgtttataaaaagcttctcttggttctccatttaaatcaccaacaatcgctgcatttttttcttttctttctttcaaaaaattagcgattaaagcggctcctttttctctagcaaattcacttgcaaaatctaaatgagtcgcaatgaaaagaatttctttatcgctatttttttctctcagaactgcccacgtagcaatccgtggacaagcagcattccaagagtaggcatgcgaccttttttcgggagtatctgacagccaaaaagtgccattgtctaagcaaaaaaacttatcttctctataaaacacgggattatactctccttcatcagaatcgtcacgtatttctccaacaaaactatacttatctaattccttcaattcttttaattgatcttcttttacttcttgaagtccaaaaacatcccaattttgtctttgaattattttcttaatagattcttttcgattctcccaactgtctaatgggtcttcgtataaaggtccactatttttaatattaaacgttcctagtctaaacatacttattctctcctataaaaatatttttaacttttttaattataacgattattgaagattatgatcttttgacttattctcttcgatttttaaatacatttttttatataaatcattgagcttatcatttggaaaaagtaccaacattttagcgcgagccatgtagtgaccccaaaagttggacttttatggagtggagaaatccactccttttttgtacgataaaatttgctgttagacagctgtttttacagcttctcgaaactgaaccggacttcgccaatttaatttcgttatgatgcgtttatggttataataatagatatattggtcaatttttgttttcaattcatctacactctgatagacttctccatgaaaaatctcttgctttaataaaccaaagaagttttccataggtgagttatctaaacaattccctttacgagacatactatggaagattttatgctgcttcaatttattcgtataagcattcatttgataggcccatccttgatctgaatggaaggttctacgaaatgagcaatcatttgtcatctggattgcttcttctaatccttccattatggctagtgcgtatggtttttcagaaatctgataagatagaatttcactattgtagagatccctgaaaggatctaaatacagctttttctgacgaacgatacctgtggtgtctaattcataatacttaaactctgtggtatcagttataattttttggtgacagatatttgtataaaaccgacgatgcatacgatttttggcgacagtaccaaccttcccacgataagaattgtaccgtcgagattttcgagtgtaagactctacttcgatacctagtttttttatcagacgttgaatcttctttttattgatatgaatcccttgattctctaattctttttttagtcgcagacagccatagtctttatgctctttgcgaatttcaagtattttttcttcaatttcttggtctgggtttagtctgtcaaatcgtttctgccaatacatataggttgctttaggaaacttcaatgtttcagaagctcaactagtttgaatgatccccggaggctggcgatgattcgtacgattgattcttgcggctttgctgggcttcctgttttcgcatcttcctcaactcttttaaaaaggcattctcaatttgaagggatcggacttgcttttctaatgccttgatacgatcgcgttcttcagttgttgtattttcttttttgttttcttttttctagtcaaagtaagaggtcgccctttcttttttgagagcctctcaatacctgcttctctgaaattacgtatccaattggtaataagcgcggggttgttcatatctaaagtgctgtcaacttctcgataggacatctcacttgtttgatataactctatcgcatttaacttaaattgaacagaatatttctgattttgacgttttctcaatagacctttctctccgtattcacgataggcattcacccaatcacttacttaagacttgcttgaaataccgtatttgttggcaagatgccgatatcctcccacgccactaagatattctttaacgatttttagttttaattcaaaatgatattttgccatacagatagcgacccccatcgcatcaggggattgtttctcatatttcatcagtgatctgcatagaccagaactttgggacaaagatccacttgagctacttaatggaatttaagagagccttgtcatactcgctctgtccagtgtcggaggaatagacatagtattatacttataacctttgtcattatgcttttgtcttcaaatccggcgaatggtgctattcttaatttctgtgtgaatagtttggcgagcacgatcaaatttctcagcaatctagctcccaaacatcgcttgtccaacgaacgaagtatttcaatttgtacacgttccttataagtaaggtgatttcctttaagtgattctgtggtattctaagtttacgtcatcgtgatttcatccttatggtagtgtcggaacttcaataatacatgaaatttttcgatggcatttttttattttatgaaacggataagttcattataaaattcacctgttttctttaattgaaataatatcgctaattgtgatttagactattactttgaattttatctaaccatatttacatattgaccacttttttacgattatttaagacactgcgatgcgcataaacttctctttcggtattttcaatgactaagccaattattatttcgttaatattaggagatagttcaataattaagtaaactttctcattcactggaacgtcaattgaatgactgttggccgccaccgtcgccactgtatagttactatccaagaaggtttttttagccgaattgatcgatagccagtactgctgacaatctttacactatcattgcctttccaatacatagtaggggtggtacctacaccattattacctccacctttaagaaactgactaccaatatagttactgtcaaagtttcgctatttagagactcactataaatgcacagttcgatgatatcgacctacttcgcttcatcggtaatcatattcatttgctgattgaataagacttcactgatagaggatcaagtatcacattagacactttcgtttatcaaatggtacgactctttaaagccttcattttctcgaaacggtccaataccatcggtgatatacatcttcttggtaatatgcagatacccgatctgctttgttccagatcatctctcgacctaaaatagtcaaataatgattgactttttccactacatctaggaaagttcacttgaaaataagccactctttatcaatgagataaccgtcacaatacattttgtgatattccatgtctatccatttgttttcagttcctactagtttataataagtatctagataaccatcttcttgagcagatgcgatataactaataatttcgtcaatctctgtgtccaaatcaggatcctgttctaattgtaagaaatacgtagcaccttataacattttatagacatcggactcgtcgaaataaatcccgataaattctccaagtatcaggctcctcttttttgaaattgtctatgcgaccactttcataacacttatctaaacaggtacggattaaaaattttttctattggttcagcttcggagtctaaaaattgttattgatggtaatttgattgaagttgatttgatttgtcatttggatcctcctatgaaaaaatgactttatgaaacacggaataagccacttttaaccagtggcctatttcgtgataaattatctattttggtgtcatgctaaatggtcgtttttggttgaagcatttaggatttggtaccataccaagttcaaaattaagattcatccctgccactaaatcatcatgagaaaaaaaggatttgtgatacacttggccagattcagtcactcgatgaataaattgttgttgcgggttattcatttcggtagtcagattaagatccttgccattagataaatggagtacggctttgtcgaaattgggcataccaatcaagtactcgtcatgtcctgggcaaaaaggatagaaccctagagagttgaaaatataccaagtagccatgctaccattatcttcatccccgggatagccttgccagccatcgctaaacaaacagttgatagcttgtttcaataaaggctgggcataataaggcttaccgatataactgtatagataaggtagatggaagctaggttgattccctacgttgatttgaccaaatccattgtactcactttcggccatttcatggattagatgaccataaccttcaacagtaaaagctggtttggaattgcccaagcgcaccaaaatatcttcaaatccctcatcactaccataaaggttgattaagccctggatatcttggacaacggcaaaattggattgccaagcacaaccttctgtgtaatcaccaccccaagaaattgggctaaagttttcgttaaatttaccttcacgatctttagccaccataaatccttcttctttcgaaaagaggttgcgatagttcatggattgatctgcatatttttgggcaagttccacctcgcctaatttatatgccaccaccgaaatacaataatcgctatagcagtaatctaacgtatgattgacagattcatgcatatcttgtggtacataaccatattccaaatattccgcacaataagagcggccaaataagcgtttttcatcttgtaccatcgccgaatgaagcattccttccaaaaattccggcatcaaatccatccgaatctctttggctgcagcatcagcaatcacagcgtcgatataattgcctggcatccctccagaatcttctggagataaccatttaggtaagaatccactttctttatagttatttaaaaatccttccaaaatcttcgaatattcttccgtttcaatcaaagaatataaaggataaaccgtccgagccgtatcccaaaagccattgttcatatagagatatcctggttttacattatcttcataaacatctcggtgaacgggttcacctttttcatcaaactcatataaccgctgagggtacaaaaacgcccggtacaaattgtgataaaaggtgctaactttatctttgtccaagtcggttacttcgatcttggctaatttctcattccatagattagtggcggttacttgtagtttagcccctggttccataggggtgtttttcacagcatatgttgtggaaataaaagaagtacctactcggagctccaccgttgatgtatcttgaaagtcgatttcgtaggtatcatcatcttttttagtcaaatttgctacaccagtttccacctcgatgtggaagtacagctttagcgggacctttccgtgagtatgcaactggttagaccaaccttcaattaccctatcttcagctttagtaattgtacccgaagttggaaaactcactagcatacctttttgatcttggggagatgtcatagtaattaaagccccgtattctgttggtacaacacttgtttccaactgattattcggctgactaatctttagataatgaggatggaattctgaccgctcaggactataagagactgttttcaagcctttggtaggacgagtatatggcaacaaacgaattgaacaaaaatctccttttgttcctgcccacatagtaggctgatgggacaaacgaaggcctctaaaatgtttagcttcaggatgaaaccaccaattatcttcgtgggtttcaacagcaaaaaaattcattccaaatggcaaagtggtaaaaggaaagcaattacctcgtgatagttcaaatgaattgctcgttgcgtgacgcgtgtcgatttggttgatgttcattgataaaaactcccttaataaatttttattttttattttttaaattactcgttgcaatataattctgtttaaacttgtctttcattaattcaacgcacttcatccaaattaacttttgctttatggtctggtgtcaataatccattaacctcttgttacacatccgtcaactgcaagtaacaatagcccgtaatgtaagagattacttgaatggctttgtgagttttttcaaatccatttataaattcaacttccattttcaccctagcttgagaagtgtaagtaccccgatgattttccatgtaaagatcttggaacggcttcttcactatcttcgattcgttcgtacagtttttaaaggtaattatccactcacgttggttgaaccgtggacatccatgggagttcattgatgattttacatcctctaccatttctctagttggaccgccatcaccattactgaagaagaccaataaatcagcgtttagcggtttgtcttggtagatgtagtaagctcgacatcaatgaatgtaggtaattgtacccattataagtcgccctacagccttcatccgaccggagatcatagttttcattcaccgtcgtaatgaaatagaccaagaattcacttctatcaatttattgacaattaaagttatcctgaggcatgtcgctggtttcattccagctaattttagtggtcctaaaattcttgataccaaagttttacataatttgtggcaaggatgttgtatacccaaagacatctggcaaccatagtactgttttttggcattaaagtgttttcctaagcaatccaatcaatacaagaattgtcgcgtcaaaatttccgcaatgtctgttttcatccaatccacaccatccacatcccagcgaccttcttgaatatgctgtttgatttgttaaaaaaatttagagcggtcttctttaatatattgataaacttgaggtgtactgtgcataaagatatagtctggatagtcttttagtaagcttagctcggtagaaaaggaacgagaagttttttccacgtatgagctaagccccataatcaagtcacatcattatggttacttcccacaacagaaacggtaaatagtttcttttctctttcatgctctttaatagaggcctgaatcatggccattgcttcttttgtctttccagcaaagatggttggagtcatcattgccaaattgaggtaattgactatttacttaatgaattttaaataggattatttgatagactaatctttggcacgcttagcaacagcttgatccatcgcatccaggtaacggatacattcatagacggtactgtaaaatttaccaccatgaataccccagtaggtaaaagtagttacgggttataaagtagtattgtggcttaggccggtccaaaaacaactgacatcttgacgtttttttcggaatagctgtaatctaatatgatatccgatggttagaatttacgctttactcggcgtgacatcagcaaaactatcgccattgtgaaaagaataccatttaacgtcttctgacaaagggttgtgcattccctgtaaatcatgcgtgctttcaattgcaaaacccgttttcagctgctcaaagcaagagtcttggatcaatcaaaactgtttgcgaagctttggtaaagtatactgccttcttcctagaaagtttatgtgtaaaaagcgattggtcagaccattagtaaaataccaaatagcattccatctgttaacatttttttgaacacatgtttactaccaatagcgaataaacacaactgctattagtttaattgaaccaaaatttctccaccggttccaacgtattgaatcactagcaactctgtttcttcagaactaattaattgtaaaggtagaatctgtccagtgtcatcctatatgacagactgggccccagtcgtcacataattcaatgcgatataagaggttaccttttaaccaggtctcccccggtttaattaagagtctccgtgacatatttaaattcaggggtactcaaatcaacaaaatatctttaaaccaatgaacatcctctttgcaagctaagtgtgttagtttggtactactcttatccgttaggtgctattacagctgataaccaagtacgatacacttcttctaatataggtgaatcacaatttgctgcaggctttccttaaagacactaacaccgctcttaaccaccgagatttgtaggtgtttttaattatcttcaatacctggcaattgttacaaatggaactaagacgtctgctgattgcgtaccccatcattccaccaagcggctatttgattgtaaggatcactttcattgcatacatatagtagggttccaccattttgtacccaagcatcaatctcactattgatagcaggcgcactgggtttcataaaatcataactcaaaacaaataatccaaaccgactagataattggctactcacaagacactatcatttcggacacaacgaatcggtatagcattttttactaatgatagcgccatgctataaaacatcggaaatgaatccgaggaataaaaatcaagtgcctctgtactcatctgtgtcgcaaaatatccctatctgaatagctcttcgatgatacaaaatcgaatcactcaaagctacttctagatgcaaatcgttattgtgtaaaaaatgatattgcggctctttcatatttcacaaagtctggaacatattgtttaattgagtacaacaggtttccaaaatcgatttgaaattatctactgccggacctttttccgtcgttcgagggtacaagctattaaagacgagatttggccacttatagagcttcatactggtgcactgtaggatggaatagcgaagcaatctccgtctcaaaatagtttttctgataaccttaccaattatacttcggattgttttcaatcgaatctgctaaaaaccacatttgtctattcggtcatttgatcgactcctgcatcaaaaaatattcgtcatacgccgtctcaaaagttaattctgtgaatttgcctcgatacatattcggcggctgactagttctcgtccactttttgaaaatatagccacccaacgaaggaatttcattaaatttaccttctggactaatgattttccattgagtgtaattgatcaagctatagatggaaatatagattcgcatagcctgtgcgtattttcgctgggaatattctttgatccaatcagccgcctagaatagttcgagcatacagataagccttcaattccgcttcctaataatgaccttacaaatcttcttgtagtgaatgccaaggcgtatggcaatagagttagtactcctttttgaatcacactgagtaaccggaaaaagtccaaaaaatctggctcttctaaatgaatcacccatcactggctttaaataaactttctctaatatagtcggcagaagctatcatgagcacatgtagggggagtctcctccatagcagacgacttcgccattttacctccatcgcgcctcagaccaatggtcctaaccgtcctatttaccatagagatagtacttgtagtctcctaaagcaatccacgtcatcaaatgaacaacatatccatgtttttaaacttttagatgcgttcaaccacaagcggggcattgacataagtaatcacaaaatataagttaatatcgatagcgggattccaaggctcgatttcttgatagctggttaactcttgattttttctctagtgaaagaaatagtttacttctttaattgggtttgttctctatggatgattttcatttattttacagttcaaaaaatatccctgccgctgacgatattgtaatgtctcaaaaagttagttttcttagtctaactttgggagcgcttcatattggttctattcggctgggctattttttatcaagctgcttaactcttgaggtatcgcctaataacacatcagtacctttactcattttgtcagttgttcataaacaaatattagaaatttttttatctttaaagatggtcggtttaagatttcgtaaaatgatcattgccaatataaggaattttctcttgtaacctatcaaagcgtttcagcatcatccccataaaagaatatgctggcaaactaatacctaaaaagagcaccaataatggattggttatatacaacaaagcagcaacacatgccatgatcactgttactacagactgcaaaggattaataaagagaaataagaatggttgcaaccaaatcttactaccttgaaggtcaaaatggacataaaccggaaacaagaagattcctgtcattacaaacaacattcgcgttgccttcaaaacaagttgcaaaataaagtcatcctgaccagcaccatttatcaaggctgtctcgaaaaataccaccacaactaaaactacaaagccgatggtaattagtaaactttctttgaaaatatcatgataaccttctttaaattccgcataaatcttactctcatattgatttcgtaaacgattacgaatacagccaaaaacggttagtgtagctggtactacaccaaatatgacacctcctctaagtgtaaacagtatccataaaatgttcaacttcatcatatagtaaatgtcattaataatgactagtaatttatttacaaccattgtaatctaccccttaattgcacctaccatgatgcctttttcaaaatatttcgctactactggataaaacaataggactggcaatgtggacacaactacaacactgtatttcaaagtcaacttcagcatcattgtttgggcacttgcactatccaacaaagcctggctggtatctccaaactgaccttgtaccaagatttctcgcaaaactaattgcaacgggaatttggaacggtcttgcaaataaatcattgcgttgaagtaatcgttccagcgagcaacaccataaaacattgccattacagcaataattggtgtggacaatggtaacacaactttccaaagtaactgcatatcattagcaccatcaacataagcactctcaataagttcccccggaatattttgttgaaaataagtacgcatcaaaatcatgttataaacacttaacgcccctggtaaaatcatgacccaaatagtgttaataatacctaattgctggtttaccaagtatgttggaatcaatccaccactaaagaacatagtaatcgtaaaaaagagtgtgaaaagtcctttcccacgaaattcaacgcgagacaagggatatgcacctaacgtcgttacagcgatatttaccaatgttccagaaaaagtatataacacggcatttctaaatccgaccaagatatcatcgtttttaaggatttcagtatacccgtctagagagaatcctctaggtgttaacaatagtggagtatcaaaaatcttcgtcggatcactaaaagaagcattgactacgaaaacaatgggatagagaattaatattgtgaaaatcagtaaaatggtgatattcacaatatcaaaaactttgtctcccttagatggtcgatatatagctttagttttcgccatttaaactcaatcctttcctatctcctaccacaaacttgtttcaccgacacgacgggcaaattggttaactacccaaaggaagatgaaattaataacattactaaataaaccaacagccgctgagaagctgtactcaccatttaccaaacctagtttataagtataggtagataatacttctgaggaagccaaatttgaagcgttttgcattaagaaggtcttatcaaagccaactgccatgattccaccagtagctagtatagaagaaataacgattgttggcataattgctggaatcgtaattttcttaatacattgtatacgacttgctccttcaagatacgctgcttcatattggtcttgaggaattccagacatagctgctgtatagatcaacgtactccagccaacactttgccaaaccccggaccagacatacatatgtggaaatgttttagcacttcctaagaagtcaatagcatctccaccaaacatttcgataatattgtttatcacaccattttgagaaccaaaaaagaagtttatcatccctactatgataaccactgagataaagtttggtatataagaaatggtttgaataaaagacttcaatttcttattactaatttcattgaacatcaacgccaagataatcggtaagggaattgaaaccaataaactgtataaactgattcgtacagtattccagataacgtttataaaaaaatatgattgaaagaagcgaataaagtgtttaaatcctacccaaggactagcaaaaataccaaaagctggcgaataatctttaaaggcaataattacgccatacattggccaataattccaaatcacaacaaaaaaaactgggattaaaatcattaagtaaagagatttgtgtttcttgatgtactgccaactctttgcccgctctttctttttaatttttttcgggctacttttcatatctgtacctcctcaaaagtgtatgaagcatcattctgctgattgataggagttactcctattaatcagttacggtgataagattgaacaatcacggcgacctttttgtcccgtgactgttctaacttttccaaaattttatagattgctggagtcatcttacatttttatattagaaacaaataaaataaaaaattatccaaagattcacaatacaacttcaacatcttactcttccatgtaacgagcatattgcgcttgacgtatttccacccatttgtccaaaccaatatttttcaattgagtcagatattcgtcccatttttcgtctacatcccatttaccagtcacgaattgaacccgagcttgttcaatatatttgttcatatctgttgtaatcgtagacaattctgaagtttcttctgacgtcgacataaaagttggtaaaataacttctggtagattttccaaaggtgcatctgtgtattcttctggttttcggccataggcaatttctttttcacgttcagttggttcattgtatggatagaaaccgccatatacattgtccatgaattggtatgctcctaattgaggaccttttgggtaattcaaaatcttgtcaacatatactttgtcgccattttccttcgcttcataagtcacaccttctttaccgaagaagccaagctctgttccttctggcccatagaaatagtcaacccatttaattaatttttctggatcagctgcatctttagtaataacaaaggagctagttcccatgacagatgattgggtaaccagagagccacccgtgccatcaggaccattcaaaatagttgttggaacataattgttcattgcttcagttccgataaagtcacgacctacccatgagaacataccaacagtatctttactagcatcagctacccatttatcataatccacaccagcaaaagcagttttggcaatcaaaccttttttatacaagttggcttcgtatttccaaacttccttcatattgttagaagagaagacaaattgtaatttcccatttttatccaagtaataattgttttccatggcagttcgaccagcagagttcaaaccaaatgcggattttaccatcaattctaacggtccaaattgtgcagaatccatatagtaaccttgttcatccgctttcccattaccatttggatccttagttacgaacgcttccaaaacttcttccaattctatcgtattggttggcacttctaatcctaatttttccaaccaaactttattgaagtacatcttgaaggaacgaccgccacccataggatcagaacaagtataaggtaaagaatagatgtgcccgtctggtgaagtgatagcttttttgatagttggatcttcttccattaatttaaccaagtttggtgcattatctttaatcaaatcttccagcgggataaacaatccttgttcgccatattttaccaactcttcatttgagaatcctaaattataaaaggcatccggcaaagtctttttagagataatcaattgtttcttatcttcccagtccttcacctcttcccagttcactttgataccagatattttttcatattcattccacatccaaagatcttctcgtttgggatggacgtcagtcctgtcaggtgccatcaaagagatagagccatcatcttttttcttacttgattctccagtttcaccaccacaagcagcaagacttaagagtgttgccgaggcaatagcagaacccactaaagctgccttccattttttcattactttttccctccatcataaattaattaactaaataaccaaaaaaattagaaatgagcataaattttattgttactatcatatataacacataaaaattattacccacgtaggttatatatcaaatagtaatgcctttaataataaatgtcaacgctttctttttttatggaatatatgatattctgtatataacattagaacaaacaatagttttagacaaatcaacattgtttttaatggtaatgataaaaaacaatttttattttaaaaaaagtctttatttctgctgtaaatatcagaaaataattatctttagtattttaataagctacaatattgaaaaaacttataaatttacactttattaaatgctaaaaaaatttagcaaagatataccacttaatttcttcaacagaaaattaaacgaactatgttatcatagtaatgaagaatttcaggaggactaatttatgaatacatctctttatgtcaaggtttacaatgacctgaaagaaaaaattatatctggagtttatcagattggggaaatgattcctacagaaaaagaactcacagaaatttacgacgttagccggattaccattcgacgggcattaactatgcttgcagaagatggcattgttgagcgaaaatctggtgtaggtactttcgtactagaagattgccaatcaggacgtcctaataaatttatcggcttgattttgtctggcctaaccgacagctacggcaaacatcttctacagtccatagtagcttccgctgatgcaaaaggatacgaattaattttaaaacttactgacgaaaattctaaaaaagaaagcgcattagtggacgaaatgattgcattaggagttagcggattattaatcgaacccgtacaacgtaatttctataatgcaactttaataaaacacatttatgccgactttccaattgtcataatcgataaagaactccaaggaatcgatagtctattcgttgggtctgatcattacctcggcgccaaagatagcgctcaaatgcttattaacaacgggcataaaaatcccgtcataatcggctacgctgaatttcgaaactctactttagaaaaacgaatcgatgctttcactaagacttattggcaatcaaatatacctttttccgctaaaaatgttgcacgaattatcactagcacttaccagtcaacagatatagatacatttcaaaaggatgtatattcaataaagaaaaacctacaaaaatttgagccatcttgcgtcgtttccctcgatgcccatgtgaacggacttgtacaacaagctttatgggagcttgacttacgctatccagacgatatttccttattcggatttgattctgcaaactcctcattcattagtaccaactatactcatctatctcaagatgaagaaactatcggtgcaaaaagtgtcgaagttctagacaaatcaattcgcaaagttcctatcaaggaccatcgcttattgattcccgccacactcaaagattttggaagcatcagtgtcttgaaatacaacctatagtatcatttagaattggatatagattcgcaaataaaaaactcgtcgtatgtgagaagtaaataggtgtgtaagaaaacactcagaaaattgaagcgacctccagaagttagacctaaaatctagcttctggggtggagatgtcaagtaaaaatagatacttagttaagagaataagtggaatatttttcaaagtctttaggagattgatagcccagggcagagtgcatgcgttttgtgttatagtaggtttcaaactatttaaatatctcaatttgagcctgatcaatatttctaaattgagcgtcattgatcagctctctttttatcgttttgtaaaaagattccattaaagcattatcacaagggtttccttttcggctcatagtagagcgttcttctattattcttagcaccgattggaatttagtacttgtgtattgcgagccttgatcagtgtgaataaccaccccggtccaggctgctcttttccaaatacttgaagaaaagaatccacaactaattgatctttcattctaagtgacatagtccacccaacaatttttctcgtatagacatcaataaatacagataaataaagtgctccttctttcagagggatgtaggtaatgtctcctaaccaaattttatttttttctgttgccttaaacgtttgattaataagattgggtcgtgaaagagagggcgattttcgattataatacttgtgtttataggtactgcctttagcataaagaccaagctgatggagaagctttcttacacgttttcgattaacaagaattccttttttatttaataattttgttattcgaatcgctccatatcttccatgatgttcctgaaaaatagtagcgatttcttctttcaagagttcattctctttttttcttttggatggttttcttttaaggaactcataaaaaccagcttttgaaacgttcaatgtctggcaagctctccggatattcaactcatttttgtgttcttttaaatactgaaatcttacttcttgtttggcttcaagaagacctggaacttttttaataagtctaattcctctcttaggtaacgattttcttgttcgagtttctttatttcataatgggcatcaaaaagtgcgctcccttttccggggaacgcactttctccatatttttcaacttcttgaacccatcgatacaagctattagcgtgaacttctagctgtaggctaacttctttaacagaaaatccttcttcagttaccagttttacagcggcgattttaaatgctttatcaaatgaacgtcttagcataatctagatcctctctttcccttaatttattgtctagtttattataccaagtccaggcgccgacctgtatcaagtacagtggcatgttctttaagtatttgaagcaaaatctgtccatcaaaaagctgtattctcaaagtgaacagggtgcgctaaatcaggtaatacttacgctgatcatttcttaatttacctacttaaccaaaatttaaatcaatatgaaagcgacacttttcaaactaaagaggtcttttcaccgcttgatgtttgcttcgataaaaaagttgatgtcggattagttttcattttaataaaacatactatttctgaaaaaaatttatccactgctaagtattcggatttttctaatttttaacaaaatttatttcggaattttctgatattatcttcgcaacattagtgaaaattcttaaataaattcattctttcaatctccgaattttagatatatgtgaaatatctgttttttgaatgtttgcataagttaaaagatgagcgtgctttagtattctttagaatagcttcttatacaggggcacgaaaaggagaaatactcgggctgacatggagagacatagatttcgataatcaaactatccgtttcaacaaaacgttagtagaactatccgatggctctctatgtattaatcctacaaaaacagacaaatcaaagagagtaatttcaattgataacggaacctcacgtattctaaaaaaatggaaacgttctgtaataaaaaagaacctttctagggggattcggatagataatatagatgatatacctgtaatcagcactatcaaagggaataaaaaaagggacttcctttacaaagtctaccctaaccatgtcatggataaagtagcacggaagttcccagatatgaagataatcaaagtccatggctttagaaagactcatgctacccttctctttgaagcaggtgctcaagtaaaagatgtacaagataggctaggacattcttcttctaaaacaaccacggacatttatattaaagtatcaaaaaatcggcaaaatgaaacagtcgaattatttgagtcttacatgaacggatgataagcgaggtcaaaaacggggtcagaggatattatgaggatacctttttccctcttaatcctttaatatcaatactttaagcttagacttttgcaatcttcccttgttcgatataagactcaaatcactatatcactagatatcaaacggcttcatacggagtcaaaaacatcaaatgtggcctgttaaatggtcattgaataacatttaaaatcaataaaacggagtcagacacggagtcaaaaacgctgagagtaaaaaaatatatacagccctgtggcactttacctatggggctgtatatttttttatttcatattacctgaaacgattccatttactttttatctcattttttcctactagttagtatcaaatactctcctattttctcaataaactattttcggctacatggtatctgaaacagctaaaaccttgtcattacagcaaaaaatcactttatctctgtttcatttcagatacatttcacttaagcggattccaaaaaaacaaaagaaaaaggaacccctagttagcctatgctttctattggttcctcttgagacacgttcatataacaacggggtagggtaaatgaatgaaaaagatggaggaatcattatttaatagctttcttaaatacttcgttataatcaattacctgcgcattattaagtatcacagaataatttttttcattttcaagtaacctaagcgggttgtctttactaacttactctgatactgcattactaactctcgttaaattagatagcaggtctgataaagactaatttcttataaaaatttttatatcagtatttataataattcctttaacttcatttacatgattaccgtttcttactgacataatcatactcggaagtctaatttgttttgaataatttaaaaaatgaaaattacttgtatactaatcaatctcaaactaataaggttaaactaattttaagtttgtgtagtgcttactgtctatatacattatttgatggctaaattcataattttcaatctctaaaataacttgaataaaatcaagagtttatcatcatctttgaccagaagaatctttctttttagtcttaattctcttttgtaaaaaagaattaaagacaacaatgagaaaccatctcaagtagtagtcttaaatttacattttatgagattcgcactataattgaaggaaataaaattaaaggaggaatcgtaatgaaatttgaacaaacaaaagaagtgttgaatcaactcgttgctgacttaagtcaaatggcaatggtcgttcaccaaacacactggtacatgcgaggacctggctttttaactttacatccaatgatggatgattttatggatgatttgaacgaccaattagatgtgatctctgaacgcttgatcacattagatggctcaccctactcaacattgcgggaaatggcagataatacacaaatccctgatgaaatcggtaactgggaccgtacgattccagaacgtttagccacacttgttgaaggttatcgttatctagctgacttataccaaaaaggaattgaagtcagtggtgaagaaggcgatgattcaacacaagatatctttatcggcttcaaaacagataccgaaaaacgtatctggatgatccaagcgcacctaggtgaagcacctcaggtagatccatcaaaatcaggtgctcgttattgattgatagagacaaagaatgttttctaatcaaaatgtacaattctattaaaatccggaactggaagtgcgaacttctattccggatttttttgcgttacactattagataatagaatttctcttttacttagagagatttgttactagcaaagaatgtttttgtgataaattggttttctttctcatgatttttaatacatttttacccccaaaaacaaatagactttgaacaagaaacatatgaagatgttcaaactcaaatcttttcattttgaattttaatttcgcggttaaaattatttaagatattatctatcaataccaacaaagatttaaaacctttcctccatattttcttgttaagtccttattctgctttagaaaactcatcaaaaaagagatgcaggaacttcggatggtggtttaggcttcttggctgggatgggcgcattagtaataacccaagagcaacaaaaaccattattttctcgaaagctatttaactagagaatactttagagaagttggcaaaagttgaattaattgtgctgccagatgttacgaatccgtaagtaggtgcgaaataattttttatgattaaaagagttgttcatggttaagcagtcgcaaatgggaaaacaggagtaaaagcgattaccgataaaattatagaatacaacaatcaaagtggcgctttaaatgagtctgatcaaatcattgattacgcaaaaaagcaaattaagagggaacaaaatgttcggtgtattaaaaaaaactgaaacagaaatattttcaccagtaaatggtctgcacgtgttattacatgtgggattagatattgtggctcttaaaggcgagggctttagcttgcttgctacagaaggataaaaagtcaatacaggggatattcttttgtcagtggacttagaagtttaaaaaaataatgctaaaaataacacattgattctggcttttcctgagcaaatcgacttgcaactttccgtcaatgaaggagtagtaacaaataaaactgttgcggtaactgtaagataataattactatataaaagttttctctagttatcaattcaagaaatttgtttgataatgggcgttagtcatgataatcaacatagcattacctccactattatttccgtttttttagaattcattgctttcttaagagcacgttctttttcttttccgtgcttactccattaataaatgatgagcgtagctgtgtccttcttttacaccagttaaaaactcagcagctttttgatcatttggataatactcaataggcaagtcgctcatagatacatctactagctcaatcaataaattctgaaaaccatcttaaagaactgaacttttgactaagccaattcacttgttgaagctgcaatagatagtaatgtctgatcaatatctaccgcctatacctgactcttcatactcggtaaactgtaagttcaagacacccgtcagtaataaattcccaatatcagaagcaatatctaataatgcaacagtttttttgtcggtaaataactattcaatcagatagaaaaacagataactaatgatatcggctgttaactgatgattcggccgtaaattctcttttttacttccttttaggagtaaaagctgacttaatttttgccattcttctgattctagatgcgttttttatttgctgataaatcttcatcactctttggaccgtctatttatctggctaccatcaattactcgcacttgatgattgtcaatcaaattctcagcgttttcaatatacgcgtctaaaaaaatatccagtgcattttaaagcagtcggatagcttccacgtttaatgtaaagacttgttcaattttttcaggaaatatcccgcacctcatttcagaaaacaaactataacaatttttatacctatttaattctaacgaatatttcaggagattttagtctatttagatgttttcagcgcttttgtttgtgaattaaagaacaaataagttagttttaaagttctaagaaaagaaaagagcgggacataattattcaagttatatcacactctcgtataatcttattaaacagcacagaagaaacacatctccacttcgttttgccctcaacaactgctacgcatgaaatatattaaaagtgaaagctaggtaaataagttgaaattgcattgaaacactattactgaaagaaattgatgttgaaacataccaatatgtgttgaaacttttcttttactagcttgtcataattttgcgtcagttttcctttaatagctgttgatgaatttggtagactgccccaatcattcctgcatcattttgaagcttcgcaggtctcactttcgcaatggtttgttcttttaaataattaatggattcatgtcgctgaatcaactcaaaaagacgttcctgaagtcgcttgttgaaggtttcattagaactaattccgcctccgattaatacaacctcaggatcaaagcagctaattaaatttagcagccccacagataaatcagtaaaaaaacgagagagtatctcgttggctaacgcttcacctgatgcttctctttttataatttctctggcatcccagacatcttcagacgctgaatttctttttttctgtgccaaattgtattgatagcataaaccacctactgttgcggcttttttgttcaaagagacttcttcaatatctcctgtcacaggaatctcatcaataaggcaccagccaaattcgcctgccattccatgacttccacgaaatacctcgccattaatgattattcccccacctattcccgttcctaaaacaatgcaaaggtaattatccatgcctttagcgttgccaatccagcgttcagcaatcgcagctgcatttgcatcattttctatacttacaggtaaaccggtaagtctttccagttccaccttcatattcattccataaaatggtttgatggctcctgccgttaacataaatccatctttttgaataattcctggtgcgctaatgccaattcccttaattgttgaataggttcgtttgaagccctctacaatctcgtgtaattcactgacaaacgtagggaagtcataatttgtgggcattgattttttttctaaaatcgtccccgtttcatctaataccccatattttacatttgttccacctatatcaaaccctacgtacatattctcaacttctctcttcggtaatatcatacttcttaaaaacgttcattaaaatgttggcattaataaaaataacggttccgataccagtgaatagccaaacaaacaataatttaggtaaatagattggtacaataacgactcctccgatagtaataaaaaacacaataatgctttgtggtaaatgtttaagcgacaaaatcattgcatttacaaccgttccagacaacgaattatcaaatcgagcaatcaatggaaatagatagagactcatcagtaccaaaaaagtgataaataccattgtaaggtagtaggcaattttatttcccaccataaagctttgtacgtatggaaaagtccaaaaacctgctccgataacagccagtatcaacacccacagttttgttgccggaagcatatttagctttagctgccgtaaatattctttatacagcacaccttcactatgatctatcatcttataggcagttccatatgcgctcgccaaagccgcaccaatcgtcaccacaggcaagcaggagaagataaaaatactattcaaaagtaaaatttgataaattctttccattccactataaatttttccttctgtactaaaaattttcgacatactcctgcctcctcatttgttgtcctttattatctactcaatcgtcttacaaacctaattttttcttattttcttcaattttttcattacgaaccttgtttacatcatcaattttattatctttttggaaattcttgtagtcttccagcaagctatctaattctttttcatcctttgctctaagcatgcccactaaggttgtactccaattcgtttgaatggcgctcaatgcacgcgcttcttgtgttccagcatccggaccaatattttctgttgggaattgtgatgtaagtttaccatctccccattcttgcatttgtttcacagcatctacataagaagcatcattcatcgctttgaaacggtcatgaccaaactggatgaattcacccatacgatactctaattgccatttttcaggatcatcttgttgaatttttcttgcttgctctgtccattgtactttattgtcagcttcaacagtatatgtttccccttcaataccaaagtttgtcagcatttctccttcatcactcaatagatacgtgaatagttgaatcgcttttgcagggtccgcacagtctttaccgatatagttaatcatccatcctgaaattcctgcttgtgttaatgttggcttgtttcctacagtactttgaattccatctatagcaatgtattcagcatctggattgtttgctttaaatgtttgcaatgggattccttggttaacaaaagaacccagcatgaccgttgcatatttacctgtttgaagtttttctttaaatttatccccatcatctgtaaacgtgtcatcagagatattgccatcttcatgtacttggcggaatgccttcacccagttgatatagtcttcgtctaaattacgatcataatattttccatcttttgtataaggaacacctaacatatcttgtacaacaccatccatagagccattagatgagccatcttttgcaaaatcattgaagccaaacggaattaaatccggatatttctctttaattttactcatgccagctgcaaagccttctggtgtagtgaaatctggttttccaattgcttcatacacatcttttctgattacgaaggcatctcgtgcaaagatgtccccactatcaaaatcactttgtgtatttgaataaccaggatagccataagattttccatctgataatttataccagttcaacgtttcttcacgagttacttcattgaaatacggatcgtaagtttttgctaaatcttgtagtggcaatgcccaagagtctgctttacgggcaacttgagaatttgaatcaaaaatcgttacgatgtccggcatatcccctcctgcaaaataggtatttaacttggtgtcatctcctgtaataaattcaatatcgatgttcagatcttctttgattttctttgttaccatatcttttccatattcggtgttccaccagtctgcattaacataccattttaatttagtcgtttcctttttcgtatctaattgccaagctggcgtttttgcatctggtgtatagcgatcttcaatagatggtaaacttacctctttatcttttgacgcctctttgttatttccacaagcacctaataacatcacacttgccaaagcgagtgtccctacaattttcttttttgataacttaaacatttccttctcctcctattcttttactgccccaagcatcatacctgagataaaatgtctttgtagcaatggatagataattaaaattggaacggtcgtgacaacaattgttgccagttgtacccccttagatgttgtgctgatttcgaccgctgcatttaagccttgttgagatgctgcctgagattgcgttataatttcgtagagtttcatctgcaatggataaagcgctctgtctgtcacatatagcttggttgtcataaaatcattccattgccacactccatgaaatagggcaatcgttgctaaagcaggtttagataatggcacaaatatttttagaaagacgccccaatcacttgcaccatcaatcttggcagattcctctaaagacgtaggaacatctctaaagaaattcatcaaaataatgacatcatagtaacttaataaggctgggataatatatacccaaaacgtatttaacaaatttaatgatttaatcaatagataagtaggaatcattcccccagaaaagaacattgtaataattcccatggtggaatacagtccgcgacctttcaaattccgtttagataaagcgtaagccataatcgcacaaaaggctgtatgtgcgaaaacgccaatcactgtttttcctatcgagataagtaatgcttgccacattgatgcatcacctaatacttttctataattatctgttgcaatctctgaaggccaaaatacaaagtctccttttgctagcgcatcactggatgcaaaagaagaagcaacaatattccaaacagggacaatgataacaatggtaaatactaacaataataaaatattgacaaagttaaaaatcttgctgtctttatcttgaacgacattactctttggttttgctaatgataagctgctctttttcatcgtgtccctccttaaagtactgattgattatcattcagttttttcgtgataatatttgttaagaccaataaaatcaccgagataatcgagattcccaatcctacagctgttgcataagaaaaatcaccttgcattaaccctactcgataaacataagagttgatgacttctgcttttggctgattttgtgaattcattaagactaatgtttggtccagatttgagttaaacaacccgctgacacttagaatcagatttaatgaaataatgtttcgaatcattggaatagtgatactccagatttgacgaagtctgctggctccatccatttttgctgcttcataataggtaggatcaattttagacatcgttgccagatacaaaattgttccccatcctgcttctttccacacatctgacagtgaagcaatccaccagtacttgctgacatctaacatatgattttgttttgtttgaattccaataaaattcaatagttcattaatcattccattagaagaaaaccaagtaataatcattcctcctaagataatccaagataaaaaatggggcagataagagatagtttgtattactcgtttaaatacgctgtctcttagttcgtatatcataaccgcaataataattggcagaacaaatccaaaggctagtttcaatccactaatgcctaatgtgttaattacggactcccaaaaatatttatcctccatgataatccgaaaattctctaaaccaacccactgtgcaccatctattgtgtctatgactgtgtaatttttaaaggcaatcactaagccataaatggggataaaactaaaaataatcatgtaaataatgccgggaatggccatggtttgcagctgccattgatgaccaaagtctttccaccattttgaaaaacgactggttgaggttgcttttgcgttctttgcttccaccctttttcctccttctttttgcttcattctttgcttatatctaacgactcaatcgtttagttgtttctcgtaccactaattgacaatccaaggtcttactttctccttttttttgattgttaattaatttcatcaactcaattactgcttgttttccttgttcttgtatcggattttgaatcgttgtcacacttggcttaaagtaacctagcagttcaatatcatcaaatcctattacactgaaatcctctggcacgctcattcctagctcatcaattgcctttatgacgccaatagcagacaaatcatttcctgcaatccatgcagttggccatttatctcgtggggtcgtcaataaataattcttgatattttcatagctctctttttcttcaaacaagccggtaatcgtccagtcgggatttattggcagttgatgctcagccatcacttcctgaaaacctagataacgttcatcactgtcataaacattagggtgtcccggtaaaaagccaagttttgtatgaccattttcaattagatgctgtgcagcaattcgacctgctttctgagaatcaaagaccacactgctaatacttccatcattgattttccgatcaacaaatacagccttcacaccctccgcacgaatcgtactcaatgactcttcatcgattaattcttcaaatccgataaatccatctaccatatttcctaataagtgagagctaagaatctgtttatccgaggaaataagtacgttcaccccatattgatagttaccagcttcctcaacaattgcttcaatcaacgtattgaagtacggacccgttatggtatgggtataaagcccaatcatctttgttgtttttgttttcaattgttttcccattaaatttggggtgtaatgaagttttttcgcggcttccgtcactcgttctatggtttttggtgttactacatccagcccgttgagtgctttggagacagtcgcaatggaaacattggcttctcgtgcaacctctcggattgttactcgctctttcatgaaatccctccaaataaaaacgtttttattttcagttaataaaaaaagaattctttttaatttatagacaaagtatagataaaaacgttttcaaaaacaatatctaacagcaagtctggttgctcaactcttcgttttgaaaaaacagtcacggtggtacagcctgtaccaccgatacacctatcctacgtactcaaaggtagctgttgaaagttctttttccgcactagtacctaaaaataaatgaaatgttcctttatctgttgttcgagccaaatcactatgcacataagcaaaatcttttgcctcaacaacaaactggacttgccttgtttcacctggatctagagatactggctgccatgcaagcaattcttttttcggacgaatgatttgcgtaaatgcatcttggaaataaatttgtggcaacgtatagcctgcttgattagatagatttgagacagtaaacgataaagtaagttgttcatttctagttaattgcttatttgaaagccttaaatcagaataaacaaattcactatagctaagtccatgaccaaatggatagagcggaccattttcttcatctaaataacgagaaatatacttttgatctgcattttctgcagtctttggacgtccggtagacatttcttgataagaataaggaagctgaccgacacttcttggataactcattggtaaatgcccgctgaaatttctctcaccactcaacaatgaggctaacgctgttcctgtttgacttcctaaaaaccaagcagagacaattgcttttacttttggttctacttctgttaaaacaagcggtctgccgctaaacgtcactaaaatactctctgtattctttttatagatggtttgaataactgttcgttctatttcacgaagcgtcaagtcagttcggctagctgcctctccagcttcttcacttgtttctcctacagcaatcaccactttatctgcacggctggctgcttcttcgattgcctgccagtctggctcttcatcggtaatcggaaggatttcaagtgttgaaacgatctttttcataccttctgataaagaactcgcagcctccatctcaccaatccatgaccaagcacctaatacatcccttgtcaccgcttttgttcctaccaatagaattttttcttctttttttaagggaagaaccccttcatttttcaaaagaaccgcacaacgaactgccgcttcataggacgctttcgtcaactcttccaaatcagcagtcgtatccaagccacgataaggattttcaaacaaacctaactcattttttaaggataaaacacgccaaacagacgcatctaacgcctctgttgcttgtgtttcttctacaatcgctgccagttctttcaggtagcaatccgtcatcatatccatatctaccgacgtttcaaacgctttttgtgctgcttgttttgatgtttcagctattcgatgcgccttcaattccgcaattgctgcccagtcagaaattaaaagcccttgaaagcccaatttcctctcaaaacattttgtactaaagaagtatttgcggtaacaggcaccccatgtacactattaaaggaagtcatcaccatttttacgccttctgaaattacgccttcaaaagctggcaagtaattttgatagagctcaacatctgaaacatcgactgtattataatctctaccgccctcagctgcaccataaccaataaaatgttttacacatgcagctacgtgtgactcattttttaagttctcgccttgatagccacgaacatacgcttttgttaacgcagttgataggcgcggatcttcaccgttactttccaagactctcccccagcgtggatcttttacatagtctgccattggagaaaaagttacatgaatctcttctttcgctgcttcttttgcagcatgccgtgcaacattttctattaattctgaatcaaaagaagaggctaaagctagaggaataggaaaaatcgtttcatacccatgaattacatctgccataaacaacaacggaattttatgcctgctgtgagcaagataattctcttgaatctttctcacctctgttgctcgatgcgttcctaagacagaacctaattgatataattgttcttcatccattgaccactgagtcataggaccggtcacttcgccttgattcccaaaaaaatctggagtcacttgcaccaattggccgactttttcttccaaggttaaacttgataataattttttcagttcttcagttttcatctttattcctcagtttgattcttaatcagttgtttataccactcaaaagaatctttctttctacgtgctaatgtcccatttccttgattatctttatccacatagataaatccgtaacgtttttccatttcgcctgttccaaaactgacaatatcaataattccccacggtgtataccctaataattcaataccatcaacattcactgctaaagccatttggtcaatatgtttttgtagatactctactcgatacggatcatgaatttttccatcctctaacttatcataggcgccaaatccattttcaacgataaacataggtaaattgtaacgttcataaatgatatttaaggtataacgtaagcccacaggatcaatctgccagccccaatcacttgcggttacatatgggttatttaccattttcgcaccaggatattcttgaacaggctcaccctgaacatcctctaatgtagtcactgcacctgacatgtagtaactaaacccaacgtaatcaacctttccttctagtaatgcgctctcttctttttcagatatttcgatggtataacctttttgctgccaatacttgcgtgcataagaaggaattttcccacgaacatgaatatcagagtaaaagaagcgacgattcattacttttacagaagccattaaatcctcaggacggcaagaatacggataaacaggaacgtatgccatcatacagccgatttggaaatctggatttatttcatgtcctagcttcacgacttttgcactagcaattaattcatttagtcctgcttggaaagtaatttcttccttattctctccttcttcaaaacgaatagctgaatttgtccatgtgtgtaaatcatgctgaccgtccgcttgattatttatttcattaaaggtcatccaatatttcactttgtctttgtatcgcgtcatgactgtttgggcataatgaacaaagaaatcaatcacttgcttatttctaaatcctccatatgtttcatacaaatgataaggaatttcaaaatgagataacgtaataacaggttgtattccattagctaataattcatcaaacaaatcatcgtaaaattgaagacctgcttcatttggctcactttcatcgcccaacggaaaaattcttgtccagttaatcgatgttcgaaacgctttcaatcctagttctttaaatagttgaatatcctctttatagtgatgataaaaatctatcgcctcatgattcggataattttctccttcaagaaccccttctgtaattttgcgagcaacaccattggctcccgcagtcatcacatcagcaatgcttacgccctttccgtcttcattccatgctccttcgacttgatgagctgccactgcaccgccccataaaaactcttttggaaattgtttagtcattacatgttcacctcgtttagttgttactcacagtataggggctgattttttgggtttcaatattctacagccactctggttaaacagtaagcaaatagaaaaaaacaccacgttggtacatgtcgtaccagcgtggtgctaaaatattttttcttttaggttttcactcttgtaatctattcgctaactgctcaattaaaaagatgcatggaatctgactcgtcaagtcttcatgtttttttacacgctttatatctacgtgataatctaaaacaaaatcggacattttagcaagcggagaattaatatcagccgtaatagcaactgtcgtgaaatcatctttattccgaaaaccattcacaatctcaacaacctcatttgtcattccagaaacagataaagttaccaaaatattatcgcttgtattttttaattttgacagaattggatacgtaggatcaatcagagcagaactattatagccaatcgatgcaaaccttcgagcagcatattcacaaatagaacctgaggcaccaatcccaaaaaagacgatattctcacaatactgaatcttctcaataatctgatttagcttactttcaatgtttctaggaaaatgatttctgcttaatatatttaacgcatcatcaaatcggtcactttcaacagattctacactaaactgactgcgaaattctgtatagctttcataacctaatttacggattaatcgcatcactgaagaagcggacgtgtgggattcttttgcaatatccctcaatcgcatataaggaactttctctacattactactcatatagtgatagattgcctgatccgtatcagataatgaattaaaatcaatatttccaaagaaacccatgttctctcccccgttttctataacgactacatgaccattactatatatcattctagcaaaaaatactagattttacgaaggttctgtgggaaaaatcattccctttaactagtaaaaatgattgagaaactcttttatgaaaatcgggtactcttactaagatcaataacatctttttacaaaaaagagcagaaattataagttgattagcctatttcgactatttccaaagctcattctttttgatccaacgtgagatggctgtttgtgagcccccatattctttgcataaactggattgaattttcccgccatgataaagattagctaagcttttttgaaatcttcatcatattttttgtaattggacataaacgttcttccttatatatttagattactcaattaatcagctatttcgttttatttagctgttattctatctataattgagttagactctgtggactagtacgttctccaccagattcctttggaatactgttaatgaaaggctctagccacatctctttgtcaaattgttaataagtttgttagcgcttgacgtctgttcgtgacgcttgattgatcacaaggttacatggcaaagagtgagtggatcacagcgtgaattttatctgattaggagtgatacttatgttgtatgttggaatagatgttgtcaagcataaacatgacttagcggttattgacacaaaaggagcgatttttattcgtcatcttcagattaaaaacaatcgtgaaggctttacgaagcttcaaatgacgcttgctaatttgcagaaatctaccggtgaagacattcaaatcgccttagaagataccgatcattattgctttaatatcttacgcttccttcggacgcaaggctacccaacctacagctataatccgtacttaattaaagaatatgtcaaaaatcaaagcttgcaaaaaaccaaaaccgataaaaaagacaccatgacgatcgctcgaaaaatacgaacagatcttgataaacaatcatttagtgctaacccttcaataattgagttgaagtatttaactcgacatacagccagattgaaagaggattatactcgaaaaaaagtaagctacacacgaattctagatattctctccagaactcacaccttctttgggttcttcttccgcgaaacaccaatcctatgtatacgcaatcttaaaagaatatccctctgccaaaaagctaggaaatgcacatttaacaaagctgactaatcttatttcagcgcactcaaagggccgctttggaaaagaacaggcggtcaagctcaaagtactcgcgcaagcctctattgatcaagagtccgccgtattagaatttgaactccttcaaactattgatgccattcagtatcttacaactatgcgagacaaagcaaagaaggaagttgctcgattaataagtgaaatcgattcgcctattttaatgattcctggcattggctataagttagggagtgtcattctcgccgaaattcgggatattaagaattttcgttcgccgaatcagctgcttgcttatgcaggtgcagaaccttccgtctccacttttggaatgaatcaaacggaaactcgacgaatgatcaaacgtggatcttcgcaattacgctgggcattgcatgagttcgccaggctcatgtctatttggtcgccatctatgcgtgtctacttccagaaaaaactagcagaaggaaaacactacaatgtcacaattagtcatgtcgtaagaaaacttgtgaggattatttatcactactgaaagacaataaacattatgagaagcagaaaatgatcattaactgatcttttcaaaaattccctttgcctagggtttctttgtcatgccttcaagccatatccaaactacgttattcagactttccatattgtgcttgacttaatatagtttgtctctcttttaggtgtcttaggttcagaacatttccaacaacgaatatctctgctagtgaagtcctgaaagcagaaattatggctaacggacttgattcaagttctgaacaagtaacaatttcagaaaatatgacaaaggacgaagtgttacactcgatttatatagaatttggtattttcaaagaacaagctgaacaagacattttttaaagcaacgcccgagtaaaacgtcaagcaactgataaaagttttgttttagtaagagtggctggcaaagccgccaaattaataatagttttgaaagcggaaccgcatatttttattgtaaaacaactgaaagtggtggttttagagctattaaagaaattattacgccgactttaattatcataagtatggtttttcaggaacaggacagtatggacttcccgatcctaatcgtattcactacacattaaacagagccttatacagtcatgcaacaacaagtattgcaggtggtggcaatgtgggtgtaaatggtgtaggaactgttaatcttagtgcaactgtaacaagcaactttatagaaaatgcttttgtgaccaaagattcaatgagttgcgtatccgtgaaatgaataagcttcgtaaagcaggacaaaaaagtcaggcagaaaaactgaaaaagaactggcactttccgctaaaaaatcgtgcaaagcaaacattaaccattacgaatacaaaacatggaaaagttttctagcacctaaatgcacgtttctatatgaagtaataatgattgatcgattttttggcttttccacgctctcaaaggaggcagatctcttttttcatgaatcagttgaagcttttcaagacaaagattccgacttatttttctccttattggcagaacttcccgaaacgttagataacggctttcggaagaagcttcaaaaccttttgacctatgaataaagcatcacaaatgcgatgatctatccttcctccaatgaaaataacaaaaattcctgtttttctatcaattcatatttatttaagaactagtttagttgattgaatatgccctactttttttgtcctataaatcttgtccgaacatattgttcaggtgcaaaatgaatctctgtatattcaaatatttgaccatcatctaaataagcccagttttgagttagtccaatacagttttcttcctgtagagctaaataatttttatctaaatcagttgctaaaattattctgtcaactaaacgtgagccaataattttatgatttgtgacagcctgaatgtatcggtaaattgattgtcctgcaatctcccttgttagtctaggtactacatctgatttgaaaaagctatcatctatcattacaggttgtccattaattagacgcaaacgaacaacatgataacaagtagtccctacttgaaacattgatcgtgatgcaagtgcagaatcaacaactattaaattcaacgaaagcaccttagtttcaattgaatctgtttgaatttttgagccacgtcccatatttccggaatcaattaataaatcttcaacaactactctttgtaagactatattagcactaccaagtttactgtatactagcccctcgccgtttaactgacgaattgcctttcggattgtattgcgagaaacgttatactctaactctaagtttttttctataggaaggatttgactttcatcaaactctccatcaagaattctcatttttaagtcttcatagattttttctgccttattaatttgaaccattttatttttctccaagaatcgaataattttttagtatataaccttccttctttatcatacaaatagtttgcgaatctgtaaataacttcaattctttaagacgagacgcattaagcgaagacaccttactaagctcttctgacatataaccaggatggcagatcacttcaacaatagaactattagcatcatcactacttatttttaaactttcatataaataatttagtgaataatctattccagcaacatttgcaattcgcttatcaggcatttttatccctgcattagttaaatagttatttattctttcatttgaaactctacgaacgggtacaccataaaaccgagcaattttaataatgatgtccgccattctataatcaattattatattcttatgataggttaagtgagttaacattaatccttgatttaacagatactcacactgagcaaaaaactctttttctatccaatcataatattcggatgttcttaccactattgttttattggggagctgacttccatcacaacatgaatgacctatctctaagttcaagtgaatccccatgtgctttatttgattcttttttgctaatctagctgcttcaacgcgatactctgatgtcgtaataaagtttgtttctgttattcctccagttgataagcccgcaataattccttctgttacactaggaactaaaccaaaatcatctgcactaacaattaagtaatgttcagttctcatgtgtaatctcttctttatacaaagcctcatctgcagctttaaaaaatggataataaattaccgtatcaattaataagaaaaatatttgtaacacacctaatttccagcttccttgtagcaacccaacaaaaaagatgggaataggcatccctaaaatcgatgctccagaaggtgctggcactagaccaattttaattacaaaatagccaataacaagattaattagtggtgcaatgatataaggtattgcatatagggcattaaaaacaatgggaataccaaaaattagcggttcattaatcccaaaaattcctgaagggagagataacttgccaagagttttatattgttcacttttagattgaaaggccattaaaatatttagacctagtgttgctccacctccacctatagaagtacataagatccaaaaagctaatccaacaatatttggaagcgggtctccattattaaaggcttctagattttgtaaatctaaaggcatgaaaacagttaacaagattggcatcaatacaagcattccatggatacctatcatccaaagtaagcgagagagcaatgttattaatagtaatgcccataaagaattacctatatttgtaatgggagtttgtataatcgtaaatataacctgatgaatacttccaaaagatgttaaagaaaataaatatcgaacaatcatagctaaagtaactatcacagctgaaggaaataatcctgcaaatgattggctcaccatgctaggaacggcatcaggcatttttagaatccaattatttttaatcatttttgtgtaaatgctaccaacagcaaatgctgtaagaatggcaacaaaaaatcccgcactccctaaccattcaaatccaatatatgacacttcttctacaactgataatggtgtcatgatgaagaaagcaattactgcaataacacttggaataatcgagtgtatgtcgtatttattaacataagtataagtaatactgataaccgcaattatcgaaataatactagtagaaaattgtccacccattgaaaaaatagttttaattccatgctccgaaataaaattttgataggaattaagagggaaatttgcaaataatgatgaaaaagctcctacaataataaccggtagaatcattgttaaacctgatgttaaaatttttaaaaaagtaaaactgtctaactttgcattaattttctccaaactctgtataaatgtaccatctgctttaaacatttaactctctccttttagggttaaccttttttgattacgtttacatattaggttaacccaatacatttgtcaagtttttgattacaaaaaattgatgaaataatacttgagaaaatgaaaaagatcatctttttgatctattaattaatcaaagtgacctagaaaaaatccgagtgagaatgagcttccttctgacccagatttgattttgcacaactcatcagtaccaaataaaaagagcatctttttttcaacaaataatccgctctaaaagagcaagacaagaaggaataaaatttaagtcatttatacaaaaacctggataagaatcaatgtttttttttaaaagatatatttttaatttaattatctttatttaagtaaaacgctataaatgagtgagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcaagaccgagtatggggaacttcatctccagattccgcgcgaccgcaatggtgagttcaagcaacagactgttcctgcttatagacggacgaatgacacgttagaggagaccgtcattcacctcttccgaaaaggtattaccatgtcggaaatcgcagacttgattgagaaaatgtatgggcattactacacgccccaaaccatgtccaatataacaaaatcatttacagaagaggtaacggcgtttaaagggcgggagcttcatgaccgttatgctgctatttatatggacgcaacgtatattccgttaaagcggaaaaccgtcgccaaggaagctattcatatcgcagttggcattcgcccggacggatcaaaggaagtattgagctatgcgattgcaccgactgaatccatcacgatttgggaggaaattttattggaccttcaagagcgcggtttgaaaaatgtcctcctgttcatcacggatggcttaaaggggatggtaggagcgattagtcggttctatcccaaagctcgttttcaacattgttgtgtacacgtttcccgtaatatcagtcacaaagtgcgtgtcgatgatcgtaaggaagtctgtgatgattttaaaatggtgtatcaagcctcatctaaagaggtggcgttggaagcacgtggtgcttttgcggaaaaatggaaaaccagctatccaaaagtggttgaatcgattctttcgaacgatcacttgctcactttctatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggccgaaggcgaacttgaacaaatgctaagccaactgattgagaattagaaacaatctgcagtagggaagaatcatttacacaaaattattgacgctcccaaatgagcatcccaatattcatttattaattattattcagcttatacaaattatatttcctacttcttatagactcaaatcactatatcactagatatcaaacggcgtcatacggagtcaaaaacgctgagagtaaaaaaatatacagccccataggtaaagtgccacagggctgtatattttttatttcagattacctgaaatgattccatttaatttttatctcattttttcctactagttagtatcaaatactcccctattttctcaataaactattttgggttacatggtatctgaaacagctaaaaccttgtcattacagtaaaaaatcactttatctccgtttcatttcagatacatttcacttaagcggattccaaaaaaacaaaagaaaaaggaacccctagttagcctatgctttttatagattcctctcgaaacacggtcatataacaacggggtggggtaaatgaatgaaaaaggtggaggaaacattattcaatagctgtcttaaatacttcgttataaaatatgaacaaataaaagacatctatccctattttctacacttccactttactaccatctttgaatcgtacaattttcttaactcttctcgtttacctcaattcattttcaagtggaatcaacttatcatctaacattttacgccatgctcgcttcatttcttgtgggtatttaaatggcttcgcttctggatggttggctttatatccttcgtaatccttactgttgataattgctttcatattaggaattggatcttcacctggcatatattgcagattagaagcatgtaattctttctcagaaacaaaccactcattggaaaaggtatgaatcaaatcatcacttgcttgtgtaaaatagcgacgtttaatgacaaagatatcttcattactatctaaagtccccacatcaaatgcatttaaaatttgtcgataaacttctttgactccttctgttttattcaatttagccaaagctttttcaatttcttctcgtgcatctgaactattcgcagcataagttcctagtaattgatcaatataagtagaatcaatatcatacaacttagtggtattttcactataaaattcgatcgttgaaaaatcttgtcctttattttctgattcttcctcgacttcaatcaaaaatcctttcactgtctggtacacaccaatttgttcttccaaaagttgaatttgattattcaaagttggggatttcaccatatcatcattataatcgtcataagtcactaacgattcatacgcacgattcaattcttggaatgctttgacatattcgatacgagtttcaagaggagtatgttcatcaatggattccatggatgaaacctcttttaacttacgatatgcttgcttgaatctttttttggattcttggtaacttggataaatcaaacccgattcttcttttgcttctgaatacagttttgtcgcatcctcgacattcttctccattgtcgctggcttacgaaacgttacaatcaatccttttgtcttttcaggatacgtacggttcgtacgtgaaaaagcttgaatcaatcctgcatactctagattacgatctacaaatagggtttgaatcgtaggtgcgtcaaaacctgtcaatagacgatccactacaatcactaaatcgatttgtttcccaaattgtttgaattccgctctttttcgtgccaaacgattattgatgtctccgttataacgctcaatgtctgctaatgaccaagaagtatcataatactgattatattcctcaataattttttgcatttcttcttgttggacacttgaatctcggctgttttcttctaaggaataggtaatagcgattcgtggaaaatcaggatcctccatcgttcttccttcacgaatgggctgattaggaaactcttttgttaaccagtcaggttctttcgtcatttctttgatcgctcgataatactttttggccatgtcaatggaactcgtggttaagattgcagatttcgttggcctgccatttcgaaaatcaaattttgtataggcattatctggacggaacattttatgaatgactttttggatatgttcatctgcttcaaaaacagctgggtccaaataactttcttttttgacaggctccatttgatcaatcatacgattgatctgttctgatgaatactctgcatatgtttctacttcttttaatttccgatagattttattctctagtgaagtcggctccacggtgttttcatgctctacttgaaatcctaagacagagccatcttctagcgcattcttaatggtataggtatgcaagacctctccatactgatcatgggttgtacgtgccaattgccctttggcttgtttccgattctcaggaaaaatcggtgtacctgtaaagccaaaccaagtggatttcggaaacatttttttgatttcttccatattttcagcacttaacgctcgatgacactcatctactacaaacacgatatgttggcccattaatttttggaagcgattggttccttttttctcttcttgtttctttgcatatttcaacgccgcatctagtttttgacgggttgtaatgattacaacatttgcattggcatctgccaacagggtttcacttaattctttggcacttcccgttccaacgatcaagctattcgctttggcgttcccggaagaaatcccagtattaaattccgaagcaaattttgtaaactctgtggtggtttgattatctaaatctttgcggtccactaacatgatcgttcgatcgatccccgattttcgtgctaaaagcttagtagatacaaaactagtcaacgtctttcctgaaccagtcgcatgccacacataccctgattgatgtttatttgcggcaataaacaaggcttgaatcgcatgtacttgataaggatgtaacaccatgagggttttattgtcttgatcttcactgacgattgtataatccgcaatcaaacgatgagcatccgggatatttaacacttgtttacaaaactcatataagttttctactttttcattgtctttcgttcgccaactaaataaaaacttagggtgcaagtctttcggtaaggcatttgcaaaataccgagtggtttgttcattggaaaccacaaacaactgtaaggtcgaaaagatattgttccgaaacataccttcttctgcatattttttgatttggttaaatgcctgataaacaccatcttttgcagttacttgtttcagctcgatttggacaatcggtaatccattgattaataaggtgacgtcaaaacgtcgatcccgtgcttctatgttacttccacgttttgcaatttgatggaccacttcataagtagagattcctccaccaatgtcttgattggaataaaggataagtgagacagaacccaattgcgaatcttcccgttcaatcgtgatccgagccatcccattttcaccttttaaccatttcgcagcatcaaatggggttttcgttcgcagcagtaattccgttttgatcgtttcaaattctttatcggtcaaaggaaaatcattcagttctgcttgattatttgagataattttttggcgtaaattgacccaaaggtcttcttctgattttagatccggacgatacgtccactgattatgcccttctccaagtacacgaatcaactgttcttcgacttctgcttcctcacggtgactaattttcattcttcttccctcctagacaaacatcttttgtaagaagctttttttcgtttcttttagtaaatctaacttacgttgatgaagagcgatcgtatcatctagctgtttgaagaaagtaccgattttttgttgttcatcctttacaggaaccttaacactgatattctcaatatcagaactgttataagaaggcaatgcccctacttgggagtatcttggcaaatttatagtttcaaacaatattttaccaaaatagatatcccaagtattattaaataaataagccatggtattgttatctattaagaaagggcttgtgaccaaacgttttctattaagcattattgctgcgccaactttagcaaatataatcgctggcacatcttttattggcttccattttttacgctcaatttgctcattagatacataatgatttgcatttctcatttcatactcattaccaatgttattcatgtcggaaactttaaaaaatggagtaccttcagaaccaccttgctcggcatcaggaaatccaattcccgattgagttttacctaattctcccaacttacgctcttcccaatcttccgtaaaaccaggaaaccggatttctggcacttttgctccgttttcagggaacattttttgtaagaatccttttttcgtttccttcagcaaatctaacttacgctgatgaagagcgatcgtgtcgtcaagttgtttgaagaaggtgccgattttttgttgttcttcctcactaggaaacattgctactatatttttaaacttttttagagacagaacatgttgacctgttccctctgcttgaatagataattgtcgttggattccattgttaatacgtcttaagaagaagtcggaatcagcagattttaaagtaaatacaggataaaaatagcttataatccctctatcaataatgtcattacggttaaacacaaacacatcattatcacttcgactacggaacgtgaaatatcctctaggtagtacaaagtaaccaatattattttctgtagttacttgccgatttgcaaaatagtcttcttgcaaaactatccctttttgttgagatgaagttagcataggaaattgattttgtacacttgtcttttcaacataatctacaacgaagtcccccaacttcctctgttcccaatcatctgtaaatcctgggaaacggatttctggttgtgtatcattgctcatgtttgaacacctccagcgcaccttgtaaccacgcttcattttcaggtgttgtttgcagggaagagatagcttctaaaagttttttttctagcacttgctgttcttgtcgtatcttcttgatgtcatttccgacatgaaccatatcaattggttcttcttcttcgaaagtatctacatagcgtgggatatttaagttatagtcattttctttgatttcatcaaaggttgccaaatgagcgtatttctcgacatcttttctttcagcgtaggtttcgaggattttttgaatgttttcttccgatagtttattttgatttttccctttaacaaattcacgactagcatcaatgaataatacatctcgagtttgacgattcttcttcaacacaatcaccgtcgttggaatcgatgtcccaaagaacaagttcgcaggcataccgatcacagcataaatactgccatcttctagtaatttttgacggatgaccccttctgcagcgccacggaataaaactccgtgtggtaagacgatggccatggtacctgtttccttcaaatgatagaacccatgaagaagaaacgcaaaatctgctttggattttggcgctaatttcccataacgattaaaccgagaatcatctaagaaagtcgtatctgctgaccaattagccgaataaggtgggttcattactactgcatcaaatgtgtaaggttcatctgttggccagtccttattcaacgtatccccattgcggagattcatttcttcggcgtcgacaccatgtaaaatcaagttcatttttgctagattgtatgtcgttgtatttagttcttgcccatgatatttaacgttatctgggtgtgttaagtagttacgtacgtttaacatcaatgaacctgaacccatcgttggatcaaaaacactaaagaatcgtcgttccttttgatcgagcgttacgatttgcgccatcatatcagaaaccatatgaggtgtgtaaaattctccggctttcttccctgcttctgaagcaaattgactgatcagaaactcatacgcatccccgatcacgtccccatcgtgttctaaaacatctacatcattcaatttcttgatgacttcggtaatcgtcacatttcgttgttgctcatctgttcctagtttttttgattggagatccacatcatcaaataacccattaaattgattgtaggtagatgccaattgcacaaaggctttgtttagatcgttcaattggaacgttgcttgttttgcttgatccgctaagacgttgaaaagatactctggtgcaattgcatatcccaaaatatcaacgattgtggcaatcagatcttcttttgattcttcatctgaaagtaattcacgatacaacattgtttgtttgcttactgtgtcatattcctctaaggattcatctgctaaaagaaccacttgttccaacaatcgatcggataaatatttatagaaaatcagtcccaataaataatttttatattctgacgcatccattttactacggagattatctgccgcactaaataatttttgatttaattctgcacccaaaaagatacactcctatctcttatttaaagttgctatataccctcttattttagcatacccccttttataaaaagcaaaaaaaaaaaagaaagaaacttattcttgctaataaactacgcgaaaggagtctaacgttgtttgatataacttagactgatcgttaacttattttttatatttctacatagttatctttagaaccatttcagatacatatgaaacaattacatatgattttttcataaaaaaacagtactgtctagtagtataaaatatacaaatttcttaaaaattttttcactaaaatcactacctgaaacagtctaaaacacttatatatcaacgtttaatgaaactatctccgtttcatttcagatacaaataaatatagtcgggctccaaatccgaaaaaaaatacccccagtagcttatcctaagctactggagatgtataagtacggtcatataacaacggggtagggtaaataaatgaaaaagatggaagaatcattattcaataacttttttaaatacttcgttgtaatcagttacctgtccgttcttaaataccacagaataatcttttttcccattttcaagtaaccgaagtggaatatctttaccaacttgctctgtcactgcattactgatacctgttagattagctaataaatctgataaagattgagcatctgtagaaatctctgtattagtatttatcgtgattcctttatcttcatttacaagtttccaagtaggtggtatagctgtgtatgtttccacaaatgaattaagtttttcattaagtgacttctcttttatatttccatctaaaaactctgtatatatggcttgagccatactaaaacaaagctgaccttgttccaataattttacatcgttagttagtaaagctgtgttcactttatctatcgcttcaagaagagtatctttggtgtccctaacagctttaggagtgccttctggaatttctctacttgatacctcgtccattttatcttccataaaacccttaaattcgtatctttctcccaaatccataaaattttttgataaagttttcatttctgagtctatttcttcaataatatttaacatgtctgatacatattgtttaggctgattcgtttttaatctatatgtggtagatatctcaatccctccaatcatcaataaaattgccaaacaaatccataataattttttctttttcatttttcctcctatctactgctgttataacagtgactaatgtaaagattttcccagtaatcattagactattatttacagggaatcaaaaaaactccttagtaagcttacacctttaggagttcctgtttggacggtatgcataatacatttaaatcaatttaacattaacacctcagtatatggtatctctacatatacacggtctttttttggatagtactcgacatttatattgatagcacttccattgtctaacgtagctttagcccggtacgtgttatcaccattatcatgagtgatcgtcacatcatcacatgtccgatttaagttatactgttcttgtaaaatctgagttaccaatggtacagatgacttctctagtccagatgaacccgtcattcttgaaaaaattatacctataatagccaatacgacgatacctataatgacaaacttcttgttcatatttactttattcaactttttatctcctatctccaaaataatttgcttttatccctcttatcagtacattgacatccctaaaagtacaccaaagatggctccagctacccctgctatcatcaaaatcgtacccatttgttcatctttatctcgatataagtagcccataataacagcaacagcaccaaatacaacaggaataaatgctaacgatactaccatagaaatccaaccaataatcaaatacagcttccctgtctcttgtccatgtacgatttgttccttcatttcattaattgtctgctcagtacttttctttactgcgtctgctccagttgtctcatctgtttcttgtagtgctccgcaaaactggcaatacttactttcatctgttatttctttgccacattttctacaatacatgtcttctcctcctaaaaacattcaattgtttattagttaactgtttactttattaaatacatcagaaaacagctcattcattggtacacttaatatctcagaaagcatcttcatttgatagggtttaggaatcgttctccctgtttgccacgaacttacacattgctgtgtaacattcattttttttgctaactccgtttgagaaagtcctttttcttttctgtatcggctgagattacttacttttttcatgattctcccctcctgttttattatatacaacaatatgatgtatttcaactcataaaatataaaaaacttcaaataccattacaaatacaacaacttgttgtactatactgagatgggggtgtattaatgaaacagaaacaatatgcaaaggtcattagagaaaagcgaaaagctctcgggtggacacaaaaagaattagctgaaaaaatcttctctacacaacaggcagtagcaagatgggaaaattctgtaacagagcctaacctcgatagcttaacagctctttctagagccctaggaacccctgtaagccattttctagacaatgttgtcgtagattatgaggaagagtttttggctctctatcgttctcttagcactgaagatgcagttcgaacaattgactatatgaagctattaaaaaggcaagaaaatgaacgcaatcagctattgaaagattgaaaaataaataacccaccgaactttaacggtgggtgtattgagatgaaataagattaagagctatggataacctgtctagtttaatacaattgggtcttttctcttccttactctccgtccatcatctcttgttacacttgtaaattgataaagaggaactaattcaactcctgataatatcaattcttttattacttcatctatccctgctccttttgctaggtagactaaaaaactactacttgctttcacattgtatagtctcttaatatccttagaagctcgttcaagagtgaatccttgtttaacaaagtagcctctgttttcttttaaagcattttccacgctgttattcccaacattacgtagacgttcacaaacagtgttagtaagttctttctctgtcattatatatgttccttgccacgataagccctgtaaaacttcatgtgcctcatctagaatcaattgtttttccttgctaagttctgatcgggaattttgcgggaatacttttttagcctcttcctcgctaaagcacatcttaacccaagcataagaaaaatgttgatatataaagtggtatttttccagtgagggcataatattttcagtcaattcttgaatcacagaagttgcattaaaggcatttagtcgatagacattgcttctcttataactaaagttcccacctttttcacgtaacgctttatctttcttttgcttattcagatactcgagcatatccatagggatatcatcgtcatctagtttttttatcaaacctataaaagtcataaatgataataacttattccatttacctactgaggaaacactctcttcaccatagtaaaaagacatttttttagctagttgttctcccgacataatacaagtcaagcttcctttactgtagtcaagaaactgaacatccaaaagcaaggtatcatagacacgtcgcatttcctctagataattctttattgtcctgaaaagcttgtcttccatagattcaagagtgtcaaaaagtacttttgattcctctttcaattttcgaaaatgtgtaggatacaggtctaggttctctaatagccaattaaaggcttctacccgactatctttctttagaattaacatcacaaccccaataaaatctacactgacaccacaattactagaatgacaatgaaaaatggaatgaccacttttcccggtaaaaatactagcagagggattatggtcgtcgtgaaacagacatcttaagtttttacttgacttaagtaatttgttcatatcaatggttaacaatctttcataaatctcattaaaagacatgtcggagggatcaaataagcaatctttaaaccactgttgcatttcttccctgtcttcattctttattaacttaacaaaatcggtttcattgactagttcatactctctctctgaatcactttgaccattttttgaacatgtcatagtgaagtcaatcggatgctcagtaatatctaacatgttgtcttcatcaattattatgactgcatctgacttatatcctccaaaaaacattctattcgaagcctttacattgtcatcacacccaggtatgttctttttcaagtattcgtaaacagaaaccattttactatgatcagtaatagcttcttttagaataaagataattttgaatttttctagatgttcagagtaccggatgcttttttgtatcgcaaacgcaaagttacgaactaaagagatagataaagccttttctatgcttaagtatctactatcatctttactcaaatctactacattattattctcatctttaacagtgttatcgacatccagaataattactctagtttctacaaagtcctcagctttgttacttttattctttgtcttgcttggaataaaagatagtgatgaatttagtatctctacaaattcatctcttgcaacttctctatagttatctaaacatctttctcttatatcagttttttctttttttgtaactggcttctctaatagcttttcttgatctacataaatattaatcactggtatttcctcctaataaaattttgataaagactaaaacatatagataataaaaacaaactctctattactatatgttttaatcttatttgtttactcaacctttataccgttccatgaaactatcaatatcagattttttgaatctaatgaccgtatcaatttttataacaggtaacccgtattgagaaacatattttctaatcgttcctactgatacacctagatattcactagcctgctggtagtccatatactctagtgtgactccagaaataatgtcttctagcataggctttagcactgtaattatctctttcacttgttgttcaacttgtatagagacaatgctatcaatgatttgcagggacatactttctccctcctttcgtgattgcttgaacaaatttcctaagaaaacaaataaataattatcttcgaattatttaatcaagataaaagtattttttcattattaaccgattaatcaaacaaaaaatgattaccggttcatcaaatgataaacatatgatacctcgataaaataggggtgtcaataattattaaaaattgttttacaacaccccttttttggtgtatactaattttaggaggtgtggtcaatatgataaagcgtccaccaataaattgtttagaacgaaaaaaaatactcggaacaaaaataaaagctataagaaagagtaagaaattaacacaaccagcattcggtattatgattaacaatggtcaattgattgacaaaaaaactgtctacgaatgggagaagggaacctatttaccaaaaccagagcgattatctcgaattgctgatttgggaaatatgagtatagaggagttagtttgtggcagtgtagaagaatatattttcggaattattctttatggagatagcattgtgttagatggtataacatttccgaataaaaatctgtcacagcatctttatcaacagtttccaccagtacaccccgatttagataaatggctgaatagatattccaaattagaaccagagacgcaagaatttattgctaacaaaacttgtaataaagttaaaaatgaaaaaattagtcttttcaatatcttaaaaatagaaaaattattcatcaatgctattgtagaagaatttgacaataacattcttttcctcactagcagtatagaagaacagctaaaaataatggtagatgaatggctacctagtcaattggaagacatgacttatcccaaagaagctgtgagagaaatttttgataatataaacaagctagaacaaacgatttcatcaattggaaaaaaatacactaagaaaaaaatgaagggaggtgataccatctagtggtaagtactccttgtaaactaagaggagatgatataatggcaaaaatatcaaagtacaaaaagaaaaacggtcaagtggcgtggatgtataaaggacacattgccaccgatccacgaactggtgaaaaaataaatactactagaaggggttttagtagcaaacaagaagctcaaaaagattatgacgaatacagacatcaaatattatatggtgctaaaaagaaagaacctgatatgacatttgaagacctgtataatgaatggatcactcatcagcgtatcagtgttaaagcttcaacaatcgcaatctcagtaagatacgcaaataatcaaatacttccagcatttggtaagcttaaattatcgaatatctctgtcccatattgtcaaaaagtggtagataaatggcacagtgaatatgaaagttacgactacatgagaaagcagactgcacaaattttacgctacggggttgcaatgcaatatattgacaataatcctatggaaaaaacacttcttccacgaaaaaaagagtatgagaaaaatcgtaaattttactcaaaagaggagcttaataatttactggatgcttttaaagattttggtaacatgaaacaatacgccttcttcagattattggcatacacaggtatgagaaagagtgaagtactcgctctacagtggaaagacatagacacgtttaataaagaactacatgtcaataaaactcttgctgtggatgaatttggtaaagttataattcaatctccgaaaacaagagcttctagaagggttatctctttagatactgagactctttctatcctcaacaactggaaattacaacaaaaagaagagtgctttaaacttggctacaatactagctctaaagagcaacatgtttttacaacacttaaaaacactctgtacattccaaacactgttaatgattggctaagatatattttgaaaaaatataacttgcctcgtattacacctcatgggtttagacatacacatgctagtttattattagaagcaggtgaatctgtcaaggtagttcaacaacgattagggcatgaaaatagtaaagtgacattagacatctatgcacatattacgaataatgcacctaagaaaacaggtcaagactttgctgatatgatggctcatcagtaaaagagctggtcaaaagctggtcatttctagtatacaggtaaaataaaaaagctagaacccttatataccaaggattctagctcctataacaagtttatcctacactgccttccatctcataacttatcaatcggtttagctcgacggcgtattccattggtagttctttggtgaatggttcgacgaagcccatgacgatcatttcggtggcttcgctttcggataggccgcggctcatgaggtagtagagttgttcttctgagatttttgagacttttgcttcgtgttctaatgatacttggctgttgtggatttcattgaatggaatggtatcggatttcgatagatcatccatgatgatagtgtcacattcgatgtgagagatagagcctgcgctcttcttgccgaaggtgacttgtccacgatagtttacggcgccgccgtcttttgaaatagatttcgagacgatggagctggaagtgtttggtgcgttgtggatcattttagcacctgtatcttggatttggttcgcaccggcaaatgcaatggagagcatcgtaccgcgggcgcctttgccatcgagatagacacttggatatttcatggttgttttggcacctaagttgccgtcgatccattcgactgtggcaccttccaatgcttttgctcgtttggttacgaggttatagacattgtcggaccagttttggatggttgtataacggcagtaggcatctttcaaggtgaaaatttcgacgatagctgcatgcaaactattactggaataggttggtgcggtacagccttccacatagtggacgctggcaccttcatcaacgataatcaatgttcgttcgaactgaccggtgttttcggcattgatccggaaataggtttgcagcggtacgtcaacgcggacgccttttggtacatagataaaggttccaccggaccaaacagctgagttcagtgcagccaatttgttatcggttggcggtactaattttgaaaagtattgcttgaagatctctgggtattctttcaaggctgaatcggtatcggtaaagatgatgcctaacttttcaaactcttctttcatgttatggtaaacgacttctgattcatactgtgccgaagccccggctaaataggcacgttctgcttcgggaattccgattcgttcaaaggtttctttgattttttctggtacatcatcccagtctcgagctgggctgtcgctaggtttttgataatatttgatggcatcgaaatcgatgtcggacagatccggtccccagttttgcatgggcattttgttgaaggcttctaatgacttcaatcggaattccaacatccattctggttcttgtttgacccgtgagatttcacgaacgatgtcttcggtcaagccttcaccggtactaaatacgggctgcacgtcatcgtggaagccaaatttatattcttctaattcgggtacacccatggttctcactcctttgttttgctgcaatctactctacttgatgctcatcggtttccgagtgtctgtgttccacatctgattgttgggtatcgtcggcgatcgctttttccaatgctttccatgcaagggtggcacatttgatccgcgcgggaaacttagccactcctcctagcattgaagcatcacctagacggtcactgtcagaaacagtatgaccttggaccaattcagaaaataaacctgacaattctccagcttcggtcaatgttttgccgatcactgcatctcccatcattgaagcactggcagtgctgatagaacagccttcaccggtaaatgccacgtctttgatggtcttcccttcaacggcgagttctaaatgaatcacatcgccacaagtgggattattcaattcaactttataggtagaatctcctagtgttccgcgatgatgggggtgactggaatgatctaatatgacttgtcggtataaattatctaatttcgttaatgccatgttggaaaaactcctttgttaacttgatggcgtcaaccaatcgatcggcgtcctctcttgtattatacaggtaaaagctggcacgtgcagttgccggtacgtgcaaatagtttaagaggggttgtgcacaatgatgaccggcacggacagcgacaccttccatgtctaatgcagtcgctacatcatggggatgaatcccgtcgatgttaaaagcgatgacacctgttcgtttggctgcttcttgtggaccataaatcgtcagtccatcaatggcttgcaattttggcaaaacataagcgaccagttcagcctcgtgttgatggatggccgctaacccaagttcactcaagtaatctaccgctgcccctagcccgatggcgccagctatgtttggagtacctgcttcaaacttccatggcaattctttccacgtgctttcttgaagatgaacgaaatcaatcatttcgccgccaaattccactggctccatctgatctaaccaataacgtttgccatataagacaccaatgccggtcgggccgcacattttatgaccagaaaaagcatagaagtcacaatctaatgattggacatcaactgacatatggggaactgcttgggcgccatctactactatcacggcttggtgttgatgggctagttgcgttaactcagcaattggattgatcacaccaagaacatttgagacatgagcaatggcaaccaccgctgttttatccgtgatctgttgacgtgcatcatccatgtcaaggataccttctggcgtcaattggatatatttcagaatcgctttcttgcgttttgccagttgttgccatgggatgatattggaatggtgctccatgtaagagatcacgatctcatcaccttcattgacaaattgatccccaaaactgcgggctacccaattcaggcttgtcgtcgtaccacgagtgaacaacacttcgtcggtttctttggcctgaataaaatggcgaactttttcccgcgcggcttcataagaatgggtcgcccgttccgccaatgtatgaacgccacggtgaacgttggcattgtcttgatgataataggcagcgatcgtcttcaaaacggcttccggcttttgggtggtggcagcattatcaagatagactaatggctcatcattgacgacttgatccaagataggaaacgcttgtttcactttttgggcatcgatcatgcaagtaacttcccttcaataacagccaccagttcttgttgcacttctttcacaggaatggctgttaagacagatcccagaaatccgcgaatcactaagcgttctgcttcttccttgcgcaagccgcgactcatcaagtagtacatttcttctggatcgacacgacccacactggcagcatgtcctgccgtaacttcatgttcgtcaatcaatagaatcggattggcatcgccacgagcttggtcagacaacattaagacccgactttcttgttgggcatcggcacctttggctccttttaaaatatgtccgataccgttgaaggtcaagacgccgcgttctctaatgacaccatgttgcaaaatgtggccgatcgaatgtggtgctttatttgtcactcgcgtatcgatcccttgtgtttgccgaccggcactgatagcaacagcttttacttcagaatgggcgccttcgccaacgaggtctgaatcaaagtcagcaatcacatcgccgtcattcatgacaccaatcgcccaatcaaccatagcgtctcgtaagacatagcctcgtcgattcatataggtagtgatattgacccccaattgatcaatagctgagaatttgactttagcccctgctttggcgatcacttctacaacgatatttccagataactttttggcttgatcccctttggtttggaaacgttccaagtagctgaattcactgtgctcatctgctacgatcaagacatgcttgaagaaatgcgcttggctattgccattatgatagaagattgcttctagtggttcttcaatgatgacattcttgggtacatataaaaataaaccactattcataaatgccgcatgggccgcagtcattttgtcttcatccattgggactgctttagtcatatagtattgattgacgagttctggtacttctctcattgcggtaaacaagtccgtaaaaatgacaccttgatccactagatgttgcggtaattgttcaaagaccgttgtttcatcaaactgaacaaccgttggatggctatccattgcatcaaaggatggaactgcccccaatcctgctgccgctggatcaatcacgccagagaattcttgttcaccgacaagtgctgcttcattgatattaaacaaaggccagcgttcataacgaacccgttcaatttttggaaacgggagttcatccacttttgcaagggctgcttggcggagttccaacatccattcaggttcttctttcaacgctgaaaacacgttgacttggtcaagataatcctgtaattttgccatttgccttgcctccttatgcttcttcttctttgtagtcgatccctaattctttactgattacagcatatccttcagcttccaggcgtttcgctaaatcagcagatcccgtcattaccacgcgaccttccatcatgatatgtaccacgtcaggagtgatataattcaacaaccgttgatagtgtgtaatgatgagcgcgccaaagccttccccgcgcatttcattgacccctttagcgacgactttcaaggcatcaatgtctaatccagagtcgatttcatctaaaatcgcaaatgttggttctagcatcaataattgcaagatttcgttccgtttcttttccccgccagagaaaccttcattcaaatagcgttctgccatttcttctggcatgttcaatagatccattttttgatctaatttctttagaaaatccatgacagagattttgtcctcttcatcccgtttagcgttgatagcagctcgcatgaattcagcatttgtgattcctggaatttcactagggtattgcatcgccaagaacaaacctaaacgtgctcgctcatccacttccatttccagcacattttccccatcgaacaagatttctccttcagtgacttcataattcgggtttcccataattgctgcagataaggtagattttcctgtcccattaggtcccatgatggcatggatctcaccggtttttaaaacaagatcaacaccttttaagatctttttatcttcaatttggacatgcaggtttttgatttctaaaactgacattctgttccctccagtatcttttctttctcactattttagactaattgagaatgaagttcaaacgcaattgcctacttttttaaaattcttctaatctagcccctagagatacattggaatcattacaaactgctgtgaggatcccctttgaaagaaactaaaaaaagacaccctcagccccgacgaaagcatgtgcttttgtctttaggaacagagggtgtcctacttgaaaactctaagcttgcacgagcaaaatgatgcaatcaaaaagaagcatcaacatttgcaagcggatgatagagttgattcattaattctgtgtcgcttttacgtccacgattggatagtaggatcacgctggttttgttgtctttagaaaacaacccaaacgattcgaatcctcctttaccaccatgagcccgaaaataagtccctttgtcataaaaacctgcggcataggacccgccagcggctggttgccacatttgcttcagtgaagctttatccagcagtttcccattcaataataaatcataatagcgatacaagtcgccaactgacatatagagatttccagttcctacctcagctgccaagttggctgaggaaatattgttagggttcccgtaaggatctgcttcgccatccgttttgtaattgaccgtaggatgatcctgctgtaaaaaggctttatacaagaaagattgtttcaacccattcttattgataaaaaaatccgttaacaacgcatcataactttttcctgatacttttgtcaaaatacctgccagtaaattgtagttgatgggactatatttgaatgttccttgggttccggataagacagcatgggtggcatcccagtcgaggatctgttgcacgtcttccagcccttgcggattttctgaaagtttgagtccggaagccatctgcagcatttgctgaatcgtaatcttggcagcgcctggaatatacggataaaagcgcgctaatgtatccgtcaaggatagtttcccttccttaattgcccgcatgatcaagaccgccgtcaatcctttttgcatcgagccaatattgaataatgttgccggggtgtttttgacatcagctgctttgtcagcatatccgtaccctttgtgcagcaggactttcccgttttttacaaccaatgcacttccaataaaaccactggaaagaattttctgatcgtagctggctccttcggctgtgacgacttcttggtcactaatgagattgtcatagttccccgcatccaacaagtcctgtttcttgtttgcgggttgctcctttttggaggaggagctgctggcagtactggaatgtgcgacttgctcactgtaatgatcagaagcagccgttggttccgttggcaaaaacaagtagtagatgccaatgagaccacaaatgattaccaggatatcgatcccaagcaatagtttttgaacgtttctttttgagcgtctttttgagcgtctttttgcatgtcttttcgtatgtctactcattgaatgaagcctccagcatccctattctccaacagtcctcctttttcatttcccctgaatatcttttggtgcctcttgctgccaatttttggagagaaaataatggttgatttcatacaacggtttttctttgaccttggaatccaagaatggctgaatgtattcatctgctgccaaccagccacgccagcctaagtgaatcgtatcttccatgaaatagggttgattgcccttcgttgataaatcagcgatattcatgaagccctggcttcttaactggtagcggatctttttgtcaaaaccggacaacacctcttgcggcaagccggtataatccatccacttctgattgatgggcggaatcacaaataagacatccacattgttgcgagcaaattctgtcagtactagttgaaagtcgctatattctggtccaaaacgataatcccatttcttttgagagcctttcattttatctatgcggctttgcagattatgttggtaaaaagaattcttgatccctaaagaattattagtcgtttctgcttttccttcattatcggctacttgttctatttgagcgagattataggtagaaggtaatttctttgcagcagcagtgattttgtcagtcaagttgtgccccaacccaagaccactaaaaagctcatcttcccgtttcaaaatagatcgttgcagatcaatctgttttttctgccaatcagtcggtatcttaccggatttcacttcattcaagacttgttccgtcaagctattttctttcactttcgaatagtctaagagacgttcggcatagtattgatcggtgtcagagactttctttaacgaagagagccaatcgtacacatgctgttcggaataatgatggttgaaatagtctcctttcaaccctttaggaacgaaccattgaggggaaacgatgaagactgcttttttccctgctaattctttcgccattgattgaatgatggcgtactgggtcagcgactgggtgccaggtgcaccaatcaaaaatggcgtataagaacgttgatatttctgcgacaatacggaaggatgggtggcactcacacggtttaattcggatgagccaaaaaatgggacatattttcctgttgctattgcctcatttttgatacgatccccgcgaaacaccacatcattcattgccgtcgccgcttgagcgatgactttcggatcgtagctattgatcttccaagggccaaggaagagtaccccgacaagaatccccacacaaagaagcggtccaaaagccgtgagtagtcgttttttcatcatcggctttgcagcgtgtcgactttctcaatgatttttgctggtgtattccactctgcccggtcaaattccgatacgggaaattcaattcctaactgcccttctagttcaaccagcaattgaacagatcctaatgaatctaataatccttcaccaaaaagatcgattgtttcgttttcttttacttcatcacttcctgtaactgattctaaaatgtctaatactgcttctttggttgtcatattcttttctccttttatttaacgaataatttgtccaagattcctgagaaaatcagaaaactaaagcaaactgcttggaaggtcaatacagtggacaccgctttggttaggttgttcgatggcagatttccttgttttttcttccaacggatccacgcatcatttccgcaaatcaatgtcgcatgatataccccgtataaaatgtaataccaggtaagtccatgccaaatgcccattaacaaaaagagggcaaaatagccgacattggatgcgacgatacggcttttgaaaactttcttcttgatcagtgtgaacattaaacgcatgtacacatagtctcggaaccaaaaagacagactcatgtgccaacgattccagaattctttgatattaggcgccagaaaaggtttattgaagttagctggtgtatcataacccatgaagttgctgacaccaatcgcaaacaaactatagccagcaaaatcaaagaacagatacatactataaacatacatataactcagcattccccaagagaacaagccattttgcagggcttctttggttacgatcggcagtaatacttgaccgagataataaccaagaatgaacttatacaggagccctagcatgattttggcgactcctttgtttaaataatcgagatacacttcttttgtcggcggattcagcagatccttctcaaagcggcgatatcgatcgatcggacccgaagaaatcgttggaaagtatagtagaaactggatataacgccaaggatggtattctttgatcagtccatcccgtatctccataatcatttgcactgatttaaaggtcagataagagatacccaagaaataaatcaatgaggcatgtccaacaaagaaaggggtgactttgctcaatgccaatggtaaaatcgctgctaccactgcaccataaaagacgcctgaagtatttgctcgttggcgatgctgataatagccatagacgagtaatgtctgatacacgacgtatccgatcagcgctagcccctgttgccaatattcaccaccaaaacttacgtacaataccactagtgtgagtaacgtttgataccattgccaacgcttttgtttgaacagcagcacaagcatcatcggaagcaatcctaccattagccaaatgaaataggtgggatttgcataaggaatcatatgctgcaggttcatgaaggattcacctcatttgtcagccatttgcggtcgattttgccatttgccgtatgaggcaactgctcaacatagataaatcgctgcggaatcatatactccatcactgtttcactcagtgaagatttgatggcttttgtcagttggaactctttctcgaatgggtgcgtttcgggaacgacataagcaatcagctgttccactttcttttcttgatatttagggactacgacggcttgtttgacccacgaactattgcttaaatgatggtcgatctcttctaattccattcgatacccatggaacttcacttgaaaatcaagacgcccttcataatgcaacaaaccatcttccgtcattctgccactatcgccggttcgatacgctggttgcccttcatggacaaaaaatgcctcttttgttttctcgggattgttcagatacccttttgacacgctaggaccactaatgatgatctcacctacttgccctttaggaactagttgatcttcttccataaagaaaaccgtcgaatcttctttcacatacccaattggcactcgatcatattgctccagtaattcttcagtgatttgcactccggatacggcaacagtcgcttcagtaggtccataggtattgtagatttttgcatttggaaaacgttccagcagtgcgtgagcggttttttttggtagttcttccccacagaataagaaacgttccaactgaggaacgtgcatcccgtcaaaggtctcttccatcaaacatagtttcataaatgaaggtgtcgagatccaaacattgatagccaattgcggcaaggttccaaacaatgttttgaagtcattaatgaccgccttttttaaaggcaccaaacagccgccagaagtcaatgctggatataaccccatgacagagagatcaaaggaatacggtgcctgtgccaaataatgcatcccttcgcgtaaagaaaaatccttcaatgtccattgcacgaaactcaataaatttccatgactaatctgaactcctttagggatgccggtcgttcctgatgtgaagatgatgtagtaaatatcatccttccctagtacttttgtagtgcctaaattgcgcccactttgatagatttcttccaattgatttatttctagcattggaatcattgtttccggaccttgccagtcagctacgctaatgatcaaatctggcgtaaccacagagaggatcaattcaatacgctcttttggcgtggtactttcaatcggaatatatgcccgacctgttttggaagctgccaaaaaggctgttagcatgtcaaattctaactcgccataaaccacgatcggtccgcgagtttccagagtttcctcgagataggcagctaattggtcggatcgagctgctaattgtccataagtatatgttaggtcatcttctcggtaggcaatcctctctggatccttttgtgcccattcttcaatggcttgcacaatatttaccacgttcatgaacattcctcctaaaattcattatagataaaggtgccaccttgcacgtttttataatgataaagataaatcagcatcaaaatgatacagaaataaaaaagggttttgcctgcaaagaagagtgcttgacgcacatgttcatttttgattcgttgtttcaccaaatccctccttttcttgctatattgattctagaatgaaggagtaaataattgaccttgaaatgttaaacaatttataaactggcgataaactttttatttcatttattagttttttttaatctgcttacatttttgtaatacaaaatggctttcacgaacaaaattgtcatctcttcataaaaaaagcaagaatctctttaaacagcacctatgctgaaaaaagattcttgctgctatattttttggcagcaactaaccactttgctgcaatgttacgccttaaagcgataccctgctccccagacggtttgaatatattgtggattggtgggatcttcctcgactttttctcttaaacgattgatatggacggcgacggttcggatgttgcctagtgcttccatcccccagattttttcatagagttgttctttgctgaagacgatctctggattttccatcaaaaagagcaataactcatactctcgatgtttgcagtcaacttcgattccatccacgtaaacccgatgcgtttgtgaattgattcggataccgcctaattcgatttcactagatacagtttctgtctgttgtccgcgcttgacccgattgtattgtgcaatgttcgctttgacccgagcgacaagttcggttggcgaaaaaggtttcgaaatataatcatccgcacctatacctaaacctcgcagcttttctaattcttctgacttggccgtgaccataatgattggaatatcgactttatcgcgaatgtttcgacaaatctcatgtccatccattcctggcagcatcacatccaataggatcaattggtatttctccgtcaatgcttcatgatagcccacacaaccgtcgttaacgatatggacttcatacccttccatttctaaaaaatctttttcgatcattgaaatatcttcatcgtcttcaataattaatactcgtacactcaacttcgatcacttcctttttgatttaactgggagggtgataacgatcgctaatccccctgctggatggttgtacgcttgaatcgttccattgaatccttcaatgattttcttcgaaatcgctaagcctaagccattgcctttgctcgggttggttcttgagcggtcatcgcgatagaaaagttcaaacaagtcttccaaattctcttccgaaacaccgctgccgttatcaatgatcgacaagataaactgttcctcaactacttcataagagacgaccacttgtttatcgttgcgatccacatacttgcgggcattttcaaatagatttgttaagactgtacgaaactgaactggatccacttctagcgaaacgttttgatccgtcggttccaatagaatcgtcaatccattcaattcgtattcctgctggataaagccgatgtattcatcgatcagttttttactagtagttgtcactagattgaaaggaaattcaccggtatccaacttagaaaacaagaaaagctgtgcaatcacttggtccaaatcatcgatcttcttttttacaatcgtaaaatatttggtccgcatggcaggtgtattagcgatccccttctctaatccttcgacataggctttgatcgaagtcagtggggttcgcagatcatgggaaatacccgcgatcaattctcgacgattggtttccagtttgttttgattatccatcatttctttcagctgacgtgccataccgttgaagtcttttgagaccggtaaaaattcatcttgcttcgtatactggatctgatattgcagatctccttctctgattttatagaaacctacagtcaataattccaaaggatcggtaatacttcttgtgagatatcgcgtcagaacacggctagtaataaaaataatcgacaaaatcaaaatcacgactaacacgatgatccgagacaacatcgctttgtaatcgcgatcccataatggatcttgataatacaaatcattgtaataatttgaattgatcaagataatcttgtagttgctggtatcaaatgtcgtaagaaaggtttgatcttttaagtaactatgttctccctcttctttaagagcagtttctttcattttttgatctgttacttcccctacagacgaaattagcttgtcgccgcgataaaccagcaatgcaatatttttgctatgattggtctttttgaaatgttgcatgtcggcgactacttctgcatctgtcgtcttctccgtatcccatttgatcaccagactttcaaccgtcgcatactgggcacgaaattcggtattcttgatcatggctccttcatctagcccccagaaataacgccagaccattaaaaaagcaatcactgaagctaataagctcaataaaactgggacaataatcatcaatatatgcgatataaataaacgctgcttgatagtcattcttttcctcttctctttgatagcgatgattcaacatagttatgcagccatcatttaaagtgttctctttgaaaaaattgggatcgcctgttttcacgacgtgatccgcctcttattgaaaggaggtgctgtctatttttttcgattttagcccatacttataggtacttcaaccgatgccttcagtcagttgtgaaagagtgaattctttcttccttgcacacgcaatgatccgatttcttacctttttaaataaagaaaataaaatttgattatcagaataataaaaactgagccaatactatagtaacaggaaatagtaaacaaaaagtaaactattgctaaaaagtaaattaaatacgaaaagtacagcccggcttctccccctaacgcaagactagctgctaattgcggcaactgtatttgttctttgagacagctttcgttatactaaaaaaaaatggaagaaaggacatacactatgacagtcagaattgaagaagtgtcccagtctacttggcgtacaattgctgccttaaaagtatcagaatcccaacatacttttattgaagacaacaccacctccttgctggaagctgcatatgatacttctttgcattgggtcccgcttgctttgtacaaagaagaaaccattgtcggctttgcaatggtcggtgcctataacgaacaagaacaaagtatttggttggatcgcttgatgatcgatcagcattggcaaaaattaggcttaggcaagaaatttatgccgttgctcctagactatcttttctgccattggacagtggaaaaaatctatttaagtgcccacaaagagaacaaaacgatcttttcgttttataccgcttttggctttaggcatacccaccacatagatccagaaaatggtgaactgattatggtatacaagaaaacgactgcgacagaacctttctaaaggttcttcgcagtctttttgcttgtttcaatgaaaatgcgatagtcgggtttcacctgacacttggactaatttgaatctgtctctattctattcgatcagtcactaaaggaatatcgattctattacttttgatttcgtcagggatcctatctgaatcattgcaatttagttaaggagttaagcgatcgtctatccttttttcaattgctgcaaaagctggatgattccacagcagcaaaaatggtttcaaagaattgatagcaaattttagcgggttcggatttatcttgcttttcaaatctaaaaataagaaatggtacccattagtcgcagctcctaatcttcttatctctaaataaagatattccaagtctgctcttcttatgtgaaatagttcctgttcctgctttttcataaacaaacaatggttttcccccaacttgattatgtcaatcgtatcttctccaatgatacatttgcaattaggcgttccagctgaacatttgacaaacccttgaggatattccttggcgtcaatttcaatcagtgctgctacccgctttccatcgagtaacattttttggatgtcatttgaaaatgtactataaaaccatgattgattactcgtttgcttgtccatttacccagctcctccctggcatacttgttcaaaaacgtttgtctataaaaggcgccattctatcattaagagtagtctactattaagaatagtctacttcttacttctcaaacatacaataacattttttattttgaatatatttttttagcttacttattttgagcaatgggcttcgcccaaagtttcttgcaccatcactcgtcttattctcacaaattccacatcatggattcttctcaaactcctattcaatgaatatacaaaagaagcacagaagtaactttctgtgcttcttttggcttgttttgattcctcactttgcacgttctttcgtgacgtttgattcgtcaatcatcagcttttactgactggaatccatagctcgcttttgcagtcgggtttagacaaatcgggactttcatgccacaaaagttcgggtcctccagttaattgataatcagacattgccagccattcgctgtaaatacgcgcccaagtttcttgaactgcttctggaaatggtcctactactgtaaagactgcccaatcagattcttccacttgtaacacatcataaggttctgatgctttttgggtagttgctacaccgacatactgatcaagcgctgttccttccacttctcgttcgacaaaatttgccgacacactgataattcctcgcggctggatatttgccagatttttgagttccataatgcgctctggcgtcagcttttcatacagtgatgtcatttgcggattctctccctgatactgcagcgtgatcctttttttgaaaccgacgatttgaaaaggttcattgtgcacgatccgatagtccattttgttacctcctttgattgtcagctggaaagtcattggtggaaatgcttttagaataacatccagctgttttgcttgtgagggagaaatgccatgcatcccacgaaaggctttgctaaaagcatccgacgaatcatagccaagtaacgttgcagtgtcgattactttcgctccttgtttcaacaagtctcctgccaaaaccaatttcctgcatcgcaaatattcgcttaaagacatacccgccaaataggaaaatacccgccgaaaatgatattccgaacaaccagctaatttagccatgtgtgtaaaatcaatttcttctaacaagttttcttctagataggccattgcctgattcatattctctaaaggattcattcgtcttctctcccatctcctacacaataacaaagttcaaagaacgtcacccggtattatcgttgcatgttttatcggttttagtcaaaagtattttttgatgccccaagtatagcatagaacaagaaattcctttaaatgcatgaacgttctctatgttttaaaaagtgtatttgtaaatagatctatttttttgagctgtcgatgtactgattcctaaagactaccgcacacaaaaataccaaaacaagaagataggctccttgttttggtatttagtcgtttactcatcgatcgttcttaatgaacaatccttgtctccacttaagaatcgacatctcgtaatcaaaaagaactgctaccttttattttcgtctttttattaaatagaatccaataaagctgactaatccaattcctataaggtttaaataactttttgatacgtcattggtttgtggtaattttgcttttgattctgaatctttttgataatttgtattttctttcttagatgttgatgtcttgtttttttgctctgaagtggatgtttttgctggagaagcatcttttgtatatacatatgtgatggtttgcggctctttccctagctttccgatccgattttctggtaattggctctcatctagatgataaccattgatcgacaactgatattctttcgtagtagcatcatagtgatcaccgatatttccttgaatggttttcgctgcatgaatttctttgccgtctttgtcaacatagacaactgtcacagctgccgctctttctgaatctttgcctttatccgaattcttcgtatacacatatgtcacggtttgcgcttgatcactcattactccagtgccattctttggcaactgtttcgtgtctaatgtataaccattgatcgttagtttgtatccatccgtcgtagtcatctccaacatttcctgaaatgacttgtggtgcgtggatctcatttccatctgtgtccacatatttcaccgtcacatctgcggcttttacagggtctttcgcgtacacataggtcactgtttgtgcttgatcactcattaccccaataccattatttggcaactgtttcgtgtctaatgtataaccattgatcgttagtttgtatacatccgtcgtagcgtcgtagtcatctccaacatttcctgtaatgacttgtggtgcgtggatctcatttccatctgtgtccacatattctactgtgacatctgcggctgcttcttgatgattgatcgcaaattgatgcaaataggtacctgaagaaatcgcgtagaagctaaacccatctggttgtgcatatgtcccggctggattattcagacgtgaattgtatttcatcgtatgaataccttcaaattcttctggggttatatcagacacagtgacgtcttgatctgtaatagatagctgagaagaaggaagttgaaccccgtttaagtcaaaatacgtttggctttgactattggatgttgaaaaaggtggaacatagccatcaaaatttgttagtcgattgggcatgatcgaaaacgggacaaaaaatgactgcgttgcagcatcataattcagctccttagcagatatcgtagtcactccatcacttcttcctgtattctgcccataagccgccagattttctaagacaggaaaattgttgataacggtgaaatcgctgaccgcacaaaattgaatccgtaattcctttaaattcggcaatgtagccaatggcgcaatcgtagtaatattcatattcgactcaaaagtaagtgattctaaattcttcatttcaagtatcttcggatagacagcatctgtgacattagcagaagaaaggttcaatcgagtaaaattgtccccaaaatcaggaacattgtcatctgtaacattcgctcccattaaataagcatagactaaactatctatcttagttaataccgaaaaatcagaaatctgattggttccattcatgtaaaaggaagacaggcttgtggcatactccaaaccggacaaatcagcaagagctgaatcagtcgaataaatatagattgtctgcattttactgattttttctttagtgatttctgatacttcgattcctaatgccttcgccactattgactgtaatgtaggatctggtaaccaactagaaacatcctcagtattggcttgattatcaggcaacgaatttgcgaactgttgagcatttgatggcaacaaacttctagctgatttttcctttgatttggcagaacttgtatctggaatcgatgattcttctgtacctactgttgatgctgttgatgttgttgatgcttcactctcagaacttgattcctttgaatcagaagtaacactttcagaggtagaagattcagtaacagtctcaactgaatcgttgctagtttcttgggtggtgtcagactgtacagagtcgtttccctccgctgctagtactgtcactacgggggtagccagtggtgaatttaataagacaaataaagatacatagctaaatatttttcgtttatttttgatctccttttttgctaatcattaccttttctttttttaaccatattctcattttaataataataatcctaaaatggaaaatagtaaagttataacttaactagtgaaatatagcacgaacgttacgcacttttcacaccccaatcacgccatttcatttgctaaaaattaataactactgtatctgtagaccaaagtatttctaggaataatggtagcaaaaaaaatagctgtacctgctttgactttgcttcaaacaaaaatcagtgtatctacgcttactctcccatgactttcaaaaaaggattgcatctaaaattgtaaattgatcagctgaaataaagctgcttcttagcttcctcgtctttcgatattgtggagcaagacaatcaataacagttggcgacaaaaaaagaccagcaaggaatatccccagctggatccacaaatagatattttttacgttttagcagttagatctgttatcgatgccaacagacggaacaaaaaatcccgtttattggtacagtgcagtttttttcttacctgcccattctttggttccattcttctcgcagcacaccgtattttactgagtcataatagtggccttcccaataacgaactctacggatttgtgcttctttcgtcatgcccagtttttccccaaccttcatcatccggtgattgcctgaccaagtcgtatatccgatccgttggatgagtggttcttgttcaaataagaatgtgatccacaaacgcatcgcatgactaccgaccccatgattccatatagtggcatcatagattgctacaccaaattcaagccattgatgcagattgccatcttcccaatatgcagtggcgattcctacaagccttccttgataataaatagccttccgtaatggattatttaaacaatttttgccaaatccatttttgaattcttcccaggttaggatagggtcctgaaaataaggtccatcccactttttccactctaagtcagctttaggaccataactgatcgaccaaagagcagaaaggttttcttcggtgattgatttcaattgtatatgatttttcatctttctccttttcaaacatcaaactgctgaaaaataaaactgaagctacttgtttttaccaaacaaacgttgaaaaaagccatttttttcggacgctgtttctttgactaccactgtaccatcggtgtccttccactttctctgaaacgtaagattatcttgtaaaagtaatccatttaactcgaggataccttttaacccagcaatcgttcggcgcaactcaccgtcttgttgaccatagaaatccttcttcccagcatcttcaagttcttctagttgccggattaactctcgaagtgtttgagcctgatctcccagaatagccgacatctcttccacttgacgttcttctatcgttggtgccgtttcgtaaatagtcactaaagataaactatcgacataatcctttaagtcaaaaagaaacgtttggcttgcttcatcttcaaccattgatgttttcattaaatagttttgtaacgcttccatttgtttttgctgaacgagtaaatctaacactaaggcctctgtgtccatcggtaccacctcctactctattgttgcgtttttcttttgcttcgtcaagaaaagcttcgagaataatgttgaaaaacagacgggctgaatagtaattgttttctctactgtatattacatatcacataccacttcttttatagtcaaatttactagtttctgcaccaccctacagttaactcaattcattgtatctctcaactacaaaaaatatcccctcggcagctaagataccgaggggattggtgcattcattgcttagccgttataagcatccacaatgatttgtttcaattcagaaatcaatggttctttagggttcgcagttgtacattggtcttcgtaagccaattcagccatacgatctacagttgcatccaatacttcttgagtcacgccttgtgctttcaagttcatatcgataccaacggatttacctaattcgtaaaccgcagttgctaatgcttcaactagttccgcagttgtttctcctttaagacctaagaatttcgcaatgtctgcgtaatctgtgtcagcacggaagaaatcatatttagggaacatcgcatgtttttgaggatctttggcattgtaacggataatatgcggtaaaagaatcgcattggtacgtccgtgaggaataccatattctcccccaattttgtgagcaactgagtgacaaatacctaggaatgcattggcgaaggccatacctgccattgttgatgcgttatgcattttttcgcgagattccatatccggtgttttcactgatttttctaagtagtcaaagactaacttgattgcttgtaagctcaacccacgagtgtaatcagatgccattaccgacacataagattcaatcgcatgggtcaatacatccatacctgtatctgctgttacagaagcaggaactgacatgacgaattgagggtcaacgatcgctacatctggtgttaatgcgtagtctgctaatgggtatttcacatgcgtatcgctatctgtgataaccgcaaatggggttacttcagaacctgtaccggaagttgttgggatacatacaaattgagttttttctggtttgtcgatcttgtatgtccgtttacggatatccaagaatttttgttttgcgccaaagaaagatgtatctgggtgttcatagaacatccacatgcctttcgcagcatccattgctgatccaccaccaagagcgattactgtatctggtttgaaatcaaccatcatcttcgttccagcataaacggtatttgttgatgggtttggttctacatctgagaagacttcgatcttcacatcgtttttgcggcgagcaagaacttcgcgaacggtatcgcagtagccgaattgaaccattcctgggtcacaaacgatcatgacacgttcaacattttccattttctctaagtataatagagagttcttttcaaagaagatttttggcggtaatttaaaccattgcatattatttctccgtttcgctacagttttaacgttgatcaagttcacagcagaaacattacgagaaacagagttctttccgtatgaaccacaaccaagtgtcaatgaagggatcatttcattgtagatattaccgataccaccttcagcagatggagtattcaccaagatacggcaagctttcatgcgtaagccaaatgccaattgcaaatcttcattttctgtgtggataaccgctgtatgtcctaatccacctaaaccaagcatagcttcacatttttggaaagcatcttctgtgttgtttgctttgatcattgctagaactggagaaagtttttcgcgagataatgggtaatctgcacccacgccatctagttctgcaatcaatagtttcgtaccttcaggcaccttgatgcctgctaattttgcgatctccattgctgaatgtccaacaattgctggatttacagcatatttgccttcattcatcactgcatcttcaagtttttgcaattcttttggttttaccacgtatacttgatgagcttcaaactctgctttaacagctgcatagacttctttatcaacgatcactgcttgttcagaagcacagatcattccgttatcaaatgttttagaaacgatcaaatcgttgaccgcgcgtttgatttttgctgttttttcgatgtaagaagggacgttacctggacctacacctagggctggttttcctgttgagtatgcagctttgaccatgcctgcaccaccagttgccaatacgatggcgattcctgggtgattcatcaataagcctgttgcttcgattgatggatgttcgatccattgcacacagttttctggtgcaccggctgcgattgctgcatcacgaacgatccgcgctgcttctgctgaacatttttgagcagatggatggaaagcaaacacgattgggttccgagtcttcaatgcgatcattgctttaaagatcgttgttgacgttgggttcgttgttggagttaccccacagacaaccccgactggttcagcaatttcgatcaaccctttttgtttgtcttcattgatcacgccaactgttttgtcatgtttgatgctattccaaatatattctgaagcatacatatttttgattgctttatcttcatagattccgcgacccgtttcttcaactgccatttttgcaagcggcatatgtttgtctaaggctgccatagccatttcgtgtacgatatggtctactttctcttgatcaaagttttccatttcttttaaggccacgtttgctttttttgcaagatcatcgatcattgcttgtacatcgatcgtcacttctttttccaatgtcttagccattgtaatcctcctagttcgttaacaatttatttgttaattacttcacatatacatcatacaataactcttttcgtttgtaaacaatttctgtgatttttttcacagttttttaaaaataagttaaatcaagcgttttcaacatatcgagttattttaatctgatgtttaagtgactcgagtatccatgtgctttattgaacaatcgttgcttttatcaagctttttccaagaaaaagaaccgatatatttgattgattctcaaatatatcggttcttagtatgatggatactgattttggttttgcatttacatagatgaacaataacactctattgtccaattttgaaggagcgtgtttcttcagaggtgatttttttcaaaaattcactcaatagaatgattgtttgcaaataatcttctttgtggatgattaatcttgaggaatgcatataccttgtcggaatcgatactgtcattgcaacaactcctgtcattgctttatggatgttgcaagcatctgtccctccaacagtcatgaagtcatgccgataaggtagtttttgtcttactgcaatctcttccatttttgcaagcagttcactattaccgatcgttagcgaatccaaaacagagagtacaggaccttttcccagttgcaatcccccttgatcaaagggagtgtctacagcggtagtgacatctaacgcaatcgccaaatcgggcttaatgctgtgggcagctgtacgggcacctcgtataccgacttcttcttgagtcgttgccgcaaagtagacatcaacagctagctcttctttggctaaagcgttcatgacctcaatacagacacccacacaaactcgatcatcccacgctttccctagcaagtaattcggatcattcatttcacgaaagaccgtcttaggtgtaaccatgtcgcctaccattattcataactggcgaatatattcagctgacggaacccccatatctaaataaaattcattagctgggatcactttattcttttcttctggcggcatcccgtggggcacgcgacttccaatgacccctgtgtatttcttgccttccatcgttgtgacacgcatttcctgtgcgggcatgacgtgtccccaccagccgcctaccggtaagagtttcaaataaccttccttggtgatttttcgaactacgaaaccgacttcgtccatgtgggctgataacatcactttgggcgcattcgctttagaactcttttttactaagatcaatgaaccaaggttgtcataaaaacagaaatcaactgctccttctgcatatttcttcacgattctggatatttctttttcccggccgccgataccatcggcttcacttaattcttttaggatttctaagtctacagctctcatagggatcgtctcctagcggttttcttctttgaatgaaacaatcgctgcttcgtctaagtctttcagaaaaagatagatggcttgaccgactgtttcataatcttcttgcgaaacaacttgagctgctgtgttcatatttcttacaggcatgttcataaataagactggacatcccgtccgtaatttgttgaaccaagcaccgtctgagtcttctaatgagaaataatattgatatggcaatgctgcctcttcacagatttttctcaattcttccatcggcaaccgatttggcaaaacggaaggatcataatatgtcaatagaactccttttgagagttctccttgtacatcgccagcatcttcctgataatcccaggctcgatttgtatctaggatgatcgttaggtctggtgcaaccagattcgctgctgtttgagcacctctggcaccgacttgctcctgaaccgtacatccaacatatagatcaaaagggaagctgagttgattttcataaatttgacgtaacaaatcaatcgtttgattgacagaaatccgtccattccaatttggagcgatccattcttttccatttttgctgacagtaaatttgggcgcaaatgtcaccatatctcccaaagaaacttcttctgacaatgcttcctcttttgaagaaaaaccaaaatctaataaaacgtcctcttttccctgaacctggtttgctttgtttcgtcctaaaatgacgcctgggaaggctttcccttgtcgattgtacaggtggacttcctgtcccaataagctattcggctcgattttccccattatcagtccgcgaatcaagccggtttcttcgatttttttgacaataaacccaagttcatccatatgggcagtcactaaaacagtggttggattctccttttcagatttgatgaccccatagatcgaacctagattgtcatagatgatttcatcgcagtaaggtgcataatactctttcaataatttagagattgttttttctcttccggaaattccgggagttttgaccactttttcgagctgatccatttgtcccatctgctttaccactccttagtaacaatgttccttcacgtaatccgttgtatcttttttctctgctttcaactgacaaagagtcaacatttcgttcattgcttctgttaatccagtaccacccttttttggcatttttacaatatctacttgatctttaaatcttgtgattgcctcttggcattcaatggacatcgccgcaacagcagggatctgaaccttctcttcgacaactttcgcaacttcagcagccatttccccgtatgtttcataattaaaacatggaccgcaaagcaacacatctgcgcctaatttctgtaccattgcggcaatctttaaagaagattccttcgcatgctttcggtaatagtcatcaccacaataaatcgtggcaagaacctccatattcttttcctttaataacttttcgaacattttgacagaaccaatcgctgtcttttgcccccctaatggctgatccccatgttctttcccaccaagtccggcttgaatttgatccagcaaaaagattattttcattgtgatcccccttctataacaagtgatcgatggaaatatcatcaaacgacaattccagttcttcacttttggcttgttctgcttcccgttcatccttcaggtattgcttgtctaatgccataatgaatggatagtagatcaaacaaccaatggctaatagaatcaattgccagacagaggcaaccagacttcctgtactcaaataccctgagaagccgatcggggtcgtccatggcaatgaaacgccggttgtataaggaatgattcctaggttggttaccaatgttgataaaagcagattaaccattggaacagcgataaaaggaataataatgattggattcaatacgactggcaaaccaaagatgattggctcattgatcccgaaaattccaggaacgagcgaaagtttccctagttctttgatccgttttgatttacagaagaggaccatgatgattacaagggaaagtgtagaaccaccgccgccaaagttggtaaagaagttcgaaaatggatccgtgaagatgtttggcaaatctttaccagcttgaaaggcatctaggttttccatggttagaattcttaagatcggcgcaaatacagaattggctaccgccggaccattaatcccaaagaaccaaaaaatcgtacaggctaaactatagaaaatctgtgcggttaatgtattaccggctccttttaatggcatttgcaagacattaaagataaaatcatggacggtaccaaaaggggtcataccaaataatatattgatgacaaaaaataagagcatgactagtgcacttggaatcagcgcagcaaaggatttcgttacagcaggtggaaccccatcaggcatcttgatggtccagcctcgttttgttgtataagcataaatttctacagaaataagtgcgacgagcaaaccgacaaaaatcccatttgttcctaagtgatcaaaagaaagcccgctaattggatctgccactccttcaacgatcagcttatttggtgttaaaatcaaaaacgcaatcacggctaccgctgccgcttggatgggatcggttttcttttcccgtccataagcatacgccgttcctagacatgaaaagaagccaactgtattaaagacagaaccagaaacccgagtgacccacgactcccaacctgtaccaaacattcctgcccaaaactctgaccaccctggtattggaaaatttgcgaacagtaagaaaatcgatcctacaatcactaatggtgtcgtgatcaaaaagccatcacgcactgcgatcaaaattttgttctgccctaactttaccgcaagcggcatcaacacattttctaatttatcgaacattccactcttcctttcgagatcttgctctttgcaatcctctttttttgaaatcataccggtgctttgatgcgtgcttcatatgcatcaagccactcttgcgtgatcggtgtgatcaccgtggtttgatctggaccaggattggccatataaatagccgcttcttggtcagctgtcgcaacgctaaatgtgaattctacatttgttgccaccccccatgccccatttttatccaatgctatcaacgaaaaggcacctgctttgccataacgtttgcgtaatcgttcttcaaacccataaacagcccggtcacaagcggcttgtggtgaaagaccttctcccatcaagcggacgatttcataagaaagacagcctttcatcaaatcttcacccaaacctgtagcggcagctccgccaatcgtactgtctacataaaatcctgagccggataatggcgaatctcccactcgaccctgttttttcatgaacaaaccagagctagaggttccgactgccatttgctgttgcgtatcgagagcaacaacgccaaccgtgtcatggccatcgtaaggatcgaggttggaagcagcgatttctgctaatcgtttttcccagattttttttgcccgatcggtcaacatattcttacgttcaaatccagccaacatcgcgtattcggtggctccttgccctactcgaaagctattgaatttctcatcactcaattggcgtgcaactgagatgggattggcaacatcggtaatccctgcaacggcaccaatcttaaatgtttcaccatccataaaagcggcatccatttcgacgattccgcgttcatttggcaatccgccataaccaactgatttataaaatggataatcttccactgctttgatggcagtttctactgcatctttgcatgacgcttgtccttctaaaagttctttggctgccagtacaccatcgtgtgccattcgccaagttgcaatcattccccacatatctttccctccatcatttgtagcgcttacaagtatattctatatggtatatactagtatgtctatactaaaaaacgagtttctttcaactatcattgatttataagaaactcgtttcggattttttttattgttgaggattcatccagggcattcttattctgttaatgctttgatgctgcgcatgtagatctctaaattcatccgtaagtcagcactgtccatgtactcattcttattgtgtgcaatccctttttgaccaggaaaagacggaccaaatgccaagatattcggcattttgcgtgcataggttgcccctgttgtggttactggtttagggtcattgcctgtgactgtgtgataaatcgtcgacagtttagctatttcggttgattctttgtctcggcaaaacccgggaatactgcgaatgacttctaattcgacaccgataggcagttgccttttcaaacgggacaatacgtctgtttctgtaacagtcgctgggtagcgaaaggcaacttccatcactaatcctgtgagagacttttgtatcacgacaggcgtcaaaatcaatttaccagaatcttcatcagccagcgccaagtcaatcccttctccaaaatgctgctgatgaaagctttgacagatccaacgaaaataagattgtatggttggaggaatagtttgtttctcagccagttgggctgccaggatcgaaattgcattttctcccaattcaggagcattgcttggagaacgtttccctgtgacttcaaacttctgatcggcaatgcttacactcaagtcgtcaggaacatggtctcggaattgatccccctgaaacgaagtgagttgctgtagttcatcgtctggcagcggaaaatggagcgctacattgacgacccctcgttcgccatagactaccggatacttacaatctggcgtaaatccgaacacaggtggttgttctgcggccaaataatgaggaacatccgacataccactttcttcatccgtaccgaaaatgatccgcagattttttttcggttggtgtcctaattctttcaataatttcatcccataaaggcaactaatgattggtcctttgttgtctagaattccccgaccataaaggcggccgtctttttcgcttaaatcaaacggcggaaaatcccagtctgaacccgcaggcaccacatcgagatgtcccaggataccgatgtagtctgacccttctggtccccactgtgcatagccgatcgcatcatcgatcacctttgttccaaatccaaaagcggcacttttttccattaccaaagacaaaactcgccgagtttccgtaccatagggcgcctgtggcataggttcagatttgacactaggaacttgcatgacttgtttgagtaagtttagaaaatccagccagttttcctcaatggctgtgctgatttggtccatttttgccaccccttatttttgacgtaccaatgtatttttaaaggtatatttatctgcacgataaaaagatgtatcgaacaagatcggtttcgcagaaggggaataagtcatcgaatggacgagaagcattggttcctcttcggatacatgcaatagcttggcaatgtctggcggacttttgaccgcttccacttcttgatgggaataaccaatctcaatgttggcttcgatcacttcatataaagaagactctaactgatctttggtgatttcgccggactctttttctaaataacgcttcaatacatagaggttctccaccgtcatcggttcatcatcaaaataacgcaaacgagtcagatacaccattggttctttcccatagttgccgaacatctgtcggatcttagtcggtaattctttcactgtctctacttgtaatacttcggttcgggtctttttcccttgggctttggccgtttcggtgaagctttgcaatccgccagatccactctggatctttggctgcttcatcacatacgttcctttgcctttttctttgactaggatattttgggtgatcagaagatcgatggctttgcggacagttagccgactgcattgaaattcttccgctaaatcataatcagaaggcagcttctgactcgttacataagtgccatcattgacacgttgggcgattttatctgctacttcctgaaaaacggcttgttttttcacttgattccctactttctactctaccattcataaaatggacgattcgcactcacaccagaagccacactaacaaaggcctggttgtcgacggattgaatcattccttcaactgtctttaattcttttcgggagatgactaaaagcaacaatttcttctgttgatgatcaaagcccccctcaacatcattgatcactgtgatccctcgctgaagtgcacattgtaatgttgcaatgacaccttctgctttttcggttactactagtaattgcacacgcctttgcttgagattcacgtagtctaccattcgaccactgataaagaaagagattgcactataaaaagcgtacggccagccaaaaatcattccagcaacgagttggagactgacattgaaaaagataaagaaactgccaatacttttgccggtcattctcttcactaagatccctaaaatatctaatcctcctgtggaaaaatcatcgtttaaagtcagaccaacggaaaacccatggagcacaccgccaaaaacagcgcagatgactggatctgtagtcaatgtgacaactgggaccaccttcatcataacagatgagaggaagacagtacaaaccgtcataagcgcgaaatcacgatcgattttgcaccatgcaatcgctaacaatggcgcgttaaaaaataagaccaacacagggattgaccactcgttaccaaagtatacttccaagagctgcgacaataattgtgaaagtccagtaattccactggcaaatatatttcctggcagccagaacatattcaatgcgatggatgataacagtgcataaatgagtgcaacagctaatcgttttattctttttggcataagcatctccttccgcttcgattatagtatatatcattaagtatatactgtcatcaaaaaacttattttctttaaagaaaccgcctttgctgatccatagtctttctcaggatcgaggggtaaaatttatcctgacatgcgggctagaaaaagagagtaaaatacttgaaaaatgactaattttgactaaaataataattggaaagaaaaataaagaaaggattgattattatgtcacatgagattgaacctcgtcgctcagatgcctatagtatgacaccttttaatttcttcgaagattttggtcgcagtttttttgatggttttaaagcgaacatgatcaaaacagatattcacgaaaatgattcggaatatctcgttgaagcagagctgcctggtattcctaaagaaaatattcaagtcacttatgagaatggtattttgacgattgctggtcaacatcaatcggatactacgactgaagataaaaaaggaaaactagtacgcagcgagcgtagtttaacaagtgttcgtcgccaatatttgctagaaaatgtcaaagaagacgacatcaaagcttcttattctgaaggtattcttaaattgactttgccaaaagatgatcacggcaaagaacctaagaaaaccattccgatcgagtagcagcatcacttttaccaaacaaacagcccccttaacagaaatgcttgttaagggggctattaatgtagaaaaagacctgttctccatgctttgcttgctgatttttttgctcttgctaaagaacaagcgaaaatctggacaaacgccactctataaaaaaagaggctgggacagaggtgctaaactcctagaaataagaaggaatacgcggaaattgcttctcaaattttggggtatttcgacttgtttccgaaggagttgcttctgctcccaccatctagacgtgtttagagcgtgggacaaaagttttttttacttttgtcccacgctctagtcctagctgtctttgtcagacggatcgaaaaaattattcttttgtatcgtctgcttttgtttcatcaacaacatcagctggttcgatttcagttgcaacagatgcaccagtaccaggtgtcacggtacgaatcgctgcccgatcgaactctaagaaaataccttcacagtcgatgacaactgtactcttgtctgtatttacttcagaaagaacgccatgaagtccgccaattgttactacgcgatctccagccttcatattttccaataagttttttcgttcttgctgttgtttcttttgtgaacggctcatgaagaaccacattgccaccaaagcaacaagcataaagagcattggtaaagattgtgccatttttttcacctcgatttttttacttttctatagatactttatcagaatctgacgtgtattcctaccgttttaccagaataaattagaaatttttggcattttctttattgaagccatattcttcgaagaaatgttgccggaattccagcaagttgtcatccatgatcgcttgacggacttgtttcatcaaattcaacaagaaataaacattgtgataagaagttaatcggatcccgaatgtttcatcacatttgatcaaatgacgaatatacgcccgtgagtaattcttacaagtataacaatcacagttttcatcaattggtcggaaatctcgggcaaactgggcattcttcacgactaaacgacctttagacgtcatacatgttccgttacgggcgattcgagtcggtaatacgcagtcaaacatatcgaccccgcgaataacgccgtcgatcagagaatctgcggctcctacccccatcagatagcgaggtttgtggtcagggatccatggtgtggtaaattccaagacgcgattcatttcagcttttggctcgcctactgacaaaccgccaatcgaataaccaggaaagtccatgctgatcaaatcttgcgcactttgtttccgtaaatcttcaaaaccggccccttgaatgatcccgaacaggccttgagaatctggattggcatgagctttcaatccgcgttctgcccagcgagaagtccgttctactgattttttgacatactcatagctttcatcgaatggcggacattcatcaaaactcatcatgatatccgaacctagtttgttttggatatcgatagctttttctggtgaaaggaacatttttgaaccgtttagatggttcttgaaatggacaccttcttcaacaatatttcgcatatctgctagtgagaaaacttggaagccaccagaatcggttagaatcggctgatcccaattcataaacttatgcagcccacctgcttcggccactagatcttctcctggtcgcagccataagtgatatgtattacttaaaatgacaccagcgcccatggctttcagttcttccggtgcaagggtcttaacagtagctaaagttcctacaggcataaacattggcgttggaaaagtgccatgcggtgtgatcaattcacctaaacgggcacctgtatgtttctctttcttgatcagacgataacgaatggcaggttgcgacattcatttccctactttctttatagactcgattaactgtgcaacgctattaatgataagggttgcgttaggaatttgcaagaaggtttcagcttctcttcctctttttcaaaaaaactttcctttctttgctttattttttgtacaatccatgctcatttgctatcatgttaaacagatagaaaggaggtttttttatgaaaactagaggacaactaaaaagtgaagccaaatccgttctgaatggacgctggaaagatagcgtattgatgtgcttggtccctacgttgatctctattgcttttgctgttgtgatcgtagtgattgttgtgttgcctttgatggcattaagtcaaaatggtgcctttgatagtcaatccatcaatgaagcgtcgaactcaactggcggtagtggcggtggcttgatcagcggattattctcagcattgtttggtgccgggatttcttggacattccttgatttgttacgcggcaataaacaagagattcgtccattttctgatgtctttcgtggatttagcggtgtattcgcacttggtatcattgtcatctatattttatcaacgattttcgttagtttatgggcattattatttgtgattccaggaatcatcaaatcctattcctactcacaagcatacttcatctactatgatacctatgagcaaacaggtacacggccagattttcttgcttgcatcacggctagccgccgattgatgaaagggtataaaggaaaactgttcttacttgatttgagttttattggctggcacattctagccattatcacagctggtatcgggtatctttggttgacaccttatatcagtgctaccaaagcagccttttatgaaaacttgccaaaacagacattagcttaaaaaaaggaccttactttgacatatcaaagtaaggtcctttttgattgaatgaaaaattgttctcaacgtaatgtttcttccgttaattgacacgttttgcttccacagcatctttgactgaattcgcaacgattttggctactccttcttggaaagcatccggaataatgtttgttggtgacagctcctcgtctggaatcaagctagcaattccttttgctgcggcaatctgcatctcaaccgtgattttgcgggcttgagcatctaaagctccacggaaaataccaggaaaagccaacacattgttgatttgattgggaaaatcactgcgtccagtaccaatgatataggcacctcctgctaaggcttcgtctgggaagatttccggtactggattagccatagcaaaaatcacaggcttatctcccatctcagcgatccattccttcttcagtgctcctggagcagaaacaccaatgaagatatcagcacctttcaacgctgtctgcaaatcaccagaaagatggtcacggtttgtcactttagcaatctctgcgtgatgaggtggtaactgatcattttcttcattcaagatccccaccttgtctacgacaatgacattttttgcaccagctgccaaaaacttacgagtaatagaaagtccagcagaaccaccgccattgacaacgattttggcttctgctagtgatttgccaatcaatttcaggctgttgaaagcagccgctaagacaactattgccgtcccatgctggtcatcgtggaaaatcgggatcgcacactcttcgatcagccgctgttcgatttcgaagcaacgcggcgcactgatatcttctaagttgattccaccaaaggtcggtgcaattgctttgacgatcgcaataatctcttctgtctcttgagtatctaaaacgataggaatagcatctacatctgcaaatcgcttgaacaaagcggctttcccttccatgaccggcattgctgcttctgctccaatattaccaagacctaacacagcagaaccatcgcttacaacagcgactgtgtttttctttgttgtcaatgaataggccagctgtttatcttctgcaatcgcggaagatacggcagcgacacccggagtgtaggcaatgcttaagtctcttcgattttcaatcgccgcttttgatactacttccaatttaccgccatgttctttggcttgtcgcaaagcgatttcttttacatcttctgacatgattcgttcctccaatagttgatcgttttttctattttttattaaaaaatcattcgcaagattgcggtcatggcaatcactgtgatggcgccgcctaaacgggtagctacttgggcaaaaggcatcaagttcatacggtcagcggtacttaagatcgctacgtctcctgtgcctcccataccgctttgacaagcagaaataattgcggcttcgatgggatacatgttcatgaaacgtgatacgacgaacccggtggcaattaccgtgaacactacactgatgacgactaagaaataagagacactcagtgttcccacaacgtctttcaatggaatatacaacaatcctaaaccagccatcaatgggaaagtaaagttgccggaaataaatttatacaattgtttggagccatgttgtgtttctgccggcaccacattcaagtatttcaaaaaagcggctaagacaatcatcaatacaggaccaggaaacccagtcaaatgctgcagtaaactaccagcaatgaacagtgtacaagcggtcagcacaccagcgcccattttcttgatatcaaaagcgccggaatcatcttttaacgcatctgccatgtcatcatcatttttcattttgaccaattgtccacccccagaaagatctggtcgtttttctccccagcgagagagcaatgcggtacacatgatcgcgaagaaattaccaatgatcgttgctggaatcagttgtgcgaccagctgttcactccccataccagtaatggcactgtagcctagtgataaaggcaagattccttcaccgatcccgccagctaacactggagtaacgatgaaaaacaacgtatgttgccattctaaacctaataatacaccaactagcgtaccaacacccatggcgcagatcatcccaatcatcatgggaataatcatccgcatcaaaccttggactaagattttgcgattcatccctaaaatactgccgcaaactaaacaagcaatataaaaatataagaagttggcttgcttcatcaaaatatcggcagactcaagaatattcggattgactaagttgaagaaaaccaaaatagatggaaccaataaagataaaattgccggaccaccgaaattcttgataaaaggaatagtggcaccaatcgttcctaataaccaccctaaagtcaaaatgaccgcaaaaccacctagcatatttacgggtaattgttgtaacagacccgtgactacgatgactgttgataaaacaatgtatactggcagcggaactgatccaattttgattttcatccaccgatcaattagcttctcttcttttgctttagattcaacctgttctctcgccacatggggttcgatatgcttttccattttgctttcctcctaaattgatctactagttctacgagtacctcgttacacacagattaaagcaagcgttttctttttcgtagtttatttaattattttaagtatttaaattaattaaagcgtctttagggattccgccgctatgttataatttacgaataaagggggaaatgtagtgaaaaaagggttacggttatggggggtattgactttagtctttacaatcgtcttactcattgtcacttccattctttatggtttagtccttattcaaaattccacatttattcgctccaacgaagaacacctgctcttgtccgtcggtaaacagctggcgatcgatccacaagtgactaccgctttggaagaaggacgttccaacgatcaattggaagcttacacaaatgaagtgacacacatacacgggttggatttcgtggtagttatggatatgcaagccattcgtttgactcatccagatgagacccaaatcggcaaacacttcgaaggcggtgatgaagtcactgcattggaaggaaaagaacatgtttctgtcagtgaaggaacattgggtcgctcgttgcggggattcgttcccgtctattccctcactgaatcgcaaaaacaaatcggtgtagtagctttagggatccgtatgcagtccttgagtgctttagtaaagagttctcgggaagggtatctacttgccttagcattaagtatcacaatcgccgcctttgcagcaactggacttgcctattatttgaaacggcaacttcataatttagaaccaaaagaaatctcacgtctctttgaagaacgcaatgccatgttggaagaaactaaagatgcggtcattgtattggatttgaaccaacaaatcaatttggcaaatatcgccgccaacgagctttaccaaaagaacagtggacacaatgactccttggtcggcaaacatttgcaggatttgatcttgcagaccgatgctgtagacttggagcgaaatgttgaacagctctatcggcaaaatggacaggattttcttttttcctctgcaccgatcaatgtggatcagaaacggatcggttggatcgtgtttttgcgcaatgcgacagaatcgttattcgtcatggatcagttagccaatactactgcttacgccagtgcgctgcagtctcagtcccatgagtttatgaataaactgcatgtgatctatgggctcgctgatttaaaagcctatgatgaattgaaaatttatctggatgatattttgactccagaaaaagagttctctcatcgcttgtcttttttagttcagaatccgcaagttgctggatttttgattggcgaacgtcaaaagttctttgagcgtaaaatccacttgatgatcgagatttcaccagaaattcccgccaattcgcaagaagttgaaacaaaatcgttgatcgatctttaccggtatattcatcatgttttgttgcaactaaacaccatagaagatttgcggatcgagatccatcatgaaacaggcctgctgacaacgacctataccattcagctgaccacaacggatcagcagcaattgcaggatagttttcacagcaactatttccaacaaatgttaaaagattaccaggcagagtttttgatagaagaacaacctaactttgtcgttctccaattacaaacgcattatcatggggtgataaaatgaaaccattacatggattaattgtcgaagatgacccaatggtggaatttatccatcggaattatttagaaaaaatcggcagatttcaagaaatctattcggcagatgctgtgacagatgctgaatacttactacaaaacaaacaagttgatttagtgctgctagatgtccatttgaaaaatggcaacggcttagacttgctcaaagagatccggaactctcagcaagccatcgaagtgatcttgatcacagcagccaatgagacacaaactattcagcatggactacatttaggtgttctggactatctcgtcaagccctttacctatgaacgtttccggcaaagcatcgaactatttctaaaacggcaagaagctttggaacaagacagtcttgcccaagaaaccattgatcaaataatggttgcaaagaagagtcccgagtcatcccttacagaactggataaaggactctctcctgataccatggatcgcatcaaagcggctatccaaacatttccagacactttcacgatcccagacttggtagagatcagcggattttctcatgtctcagtccgtaaatacatgctttacttagaaaaaaataactatgttaccagtcagattatctataccaaaatcggacgcccttataaagtttaccaacgatcctaacaattagtggactctctctaggaacgtcaacgagtgattgctgatttgctgattattgaataaacgatgttttagtaagtcagctttttagattttaaattgtgaattgatcgttgtactttgtataccctatctatttgcaaacgcttcctaaatatgctatagtataggtgtaaggaaggtagcaactctgttggtggtcttgtaaatatcgcaaactcaatctactaaaagttgttgaacgtacaagtttcacctagtatcaagcgtgtaaagtaacagaaaagcgtaacacaaaatcgagaatcttttcgaaaaaaggatacgtctattacgttgtatcagtacacacgaaacatgtgtaagtttgtaaaagaaaacaaattttgagaaacaattgctttgcatgaaccaaccatcagcgaccaccacttataccttcccttagttataagctggacgacaaaaaagcagttcaaaaagttgagaagtatcccaacttaacgagccgctcttgtcgttcagttttttattttaagaacatggcatcgccaaaactaaagaagcgataacgttcatcgatggcatgctgataagcttctaatgttagatcgcgtccggcaaaggcactgaccaacattaccaatgtcgatttcggtaaatggaaattcgttgagaaggcttggacaactttgaactgatagccgggggtaatgaaaatactcgtccagccgctgtcggctttgatatcgccatcaaatttggtaccaatcgtctctaatgtacggatcgaagtcgttccgaccgcaacgattttcccaccatttgcccgcacatcgtttaattgagccgccgcttcttccgtcaatcgataaaattcactgtgcatttcgtgatccgcaatattatcgacgctaactgggcggaaagttcctagacccacgtgtaaggtcaaataaactaatttgacccctttatcagcgattttcttcaataattctggcgtaaagtgcaaaccggccgttggtgccgctgcagatccattctctttagcataaacggtttggtaacgatctggatcttccaatcgttccttgatgtatggcggcaatggcatttcacccaaagattctaaaatctctaagaaaatcccatcatagctgaatcgaataattcggccaccatgttcgagttctttttcaacgaccgcttctaagcgaccgtcgccaaaggtgatcttcgtaccgacttttgctcgcttggcaggtttgattaatgtttcccaactgtccccttcgatattgtttaacaataaaatctctagatgagcgccggtctcgattttctcgccatagatacgagcgggcaaaacgcgagtatcattcatcacaagggcatcgccaggagctaattcatcaataatgtcataaaaatgtttgtcttccattgcaccgctttctcggtccacgaccaataggcgggaactggagcgatcgctaagcggcgtttgagcgatcaattcttccggtaactcaaagtcaaaatcttctgttgtaagcatgtcgtcactctctttctttcatatgcccgtctattctatcatgtttagagattactcgccaattaggaaactaggcatagctttaaataaaaagagcgctagagagagactagaaccttttcacggtgctcctaatctattagagaattttaaccgataacacggaatcttctgccttttttatctgctttatcgttttgtgaataaaacaaaattttttcacgtgggattttttcttgctgagcacattttttcaatgtgtcataaacataactgctgttgtttttataaaaaaccatgacttttttcgagtcaatttctttgcgatagtcttcatatttctttcttaatcgttcaacttctgtaacaatctctgaatctttattccaatcgggaattgcagtaagcaagcaaattcgtttccagtattctttttccattattcaaactaaccacgaaagacatttaggttgaactgctaacctatgctttacgaatcacttcgtctctatcgattcacttctatcgaaaattcataaagccatcctttcattcctttcttaatcgctccaaggagaactatattcaaaaaatgctacttgttccattacttgtcctattcaacactgggataattaagaataatacgataattatcaataaccgctttgatgttttggccgtcagcaaaagatacttcaaatagtggactatctttttttattgaggaaatttcaatgtttagatacttaaaatatgcccctaaaattttctcaggatctatctcttgaaatgattgctctgggtaatatttaaattggacgattttattagtcgattcctcaatcagggcttccccataaccttcgatcgaagaataattgatttgccaataaacagtttccgaatcaatctttagattctgggataacgtaaccaagtattctgaagagattcccatttcttttagcagcttctctatttccaccgcatatgtattgacatactggcttccttctcccgtattattatattgcgttactttcccggcgttcgtgagcacttcttctaatgtacttttatttgaaggcagctccaaggattcttcaaatacgactggctttgacaatgaatctgtaaacagcatatttggtaaaaatagtagaaatacgttgaaaccgacccataggaggatcagacttatctttattcttttcctcatcttcagtcctcatctaaaggaaagtcgatcgtaataaacgttccttcacctttctcactagtgatcgtcacttgcccttcatgaagtgagataatattcttcactaatgaaagccctaagcctaaatgcccagaatttctagtgacatcccccgtaaaaaattcatcagtgacttgatcaataatctcttcgggaattccctgaccagtatctttcagtataaaataatatcgtccttcattactgtagccagtgatgcacatctctttcctatccttcatcgcatctaatgcgttagaaaatatatttgcaatgactaatttaaataggttaaagtccattcgtatggtggccttttgaagagtcatctgcaaaaggatccgctcatctaatccagagacaaattgagtaatataagagtcaatctggtctgtcgatattgcttcgagattcatttcatttttcttcgagtacaataaacgcaaaacatcttctgataggcttttcaagcggaaactttcttctaaaatataatcgacaaattccgaagaaggttcctttagatcctcccactgcaacatttgcgcatagccgatgatcgacgttagcggggtagaaatttcatgggataaacttgagacaaataattcttgcttttctttttcctgactgatttgttctatgtcttgatttaatttattggccatgtcgtttaggctgttggcaagcttttcaacttcatctccacgtttttcaacaacgaaaggctttgttgtttgcccttttgcaatctctgttgcgcgatcaatcaatttttgaatcggtttagtgatgagggttgataaaaaccacgacattggaatcaaaacgatctgcaaaagaaataaaatcattcgaaaataatgacttgctttcttcagaatactttgataagtgattagattctgcttagacaccaaataatagtctgtcgttccaattgtcgagcttgtaaataaaaacttctcttgtttgattgtgatgattgggctaatgttgattgtgttcttcttaattgaatcgtaatcaacaacctctgttatgcttggaaagtcagttgtactggcatacacactctttccttctttatccaaaatttcaaaatcattctttaccgtgctcttgactatatcacttagattccgtaactgctctttcgtaggttcttgatcttcaattttggctgcaaatagtatcgcagcacttttttgggtagctagtgcttgatcatattcctgattgattgcatgttgagcgatgatccgcaaactgatggtgctgatccctaaatacaaaagtaaaaaaaagaatagcagccaatagaatgcttttgtcgcatatttcatcttattcctccaataagtaccctacaccataaatcgttcgcagctcgttttccaaatgcagtttctttctgatccgctgaatgtgtaaatcaagagttctgctatctggctcacttggcgattcccaaattcgttgataaatcgtttctcgctctaaaataattccgcgattttgaacgagataaatgaacaattgatattctttaggcgtcaatgcaatcaactcattgttaaaaaatacacttctcttctcgtcttcaatacggatgttgtgccaatttatctcagaaacagaactctttttccttctgcgaagtactgtttcaactcgagcaaataattcttctagttcaaaaggtttcgtaatgtaatcttctgcacctaactttaatcctcgcactttatcatgcaaggtattcttggcagttaaaaagataactgggatatcaaattcgacaaaatagtctattaattcatccccacttatttctggtaacatgatatctaaaagaatcagatccacctcatgattttcaatgtaatctgcggcacttttgccatcaaaaatcgggatcgttcgatagcctttttttgcgaggctttttactagcaggttatttatggcttgattgtcttctactatgagtacatccatttgatttcacactttcttcccaatttttgtaaagaagctgttttataagctgatagccgatcatgataccgcacaaaaaaagatagagcaaaagtaaaagtacgatcgatcgattgtcaatatcttcaaaatcagcgaaaattttttgaagcgcttgattgtgacgcacaaaaatatctgtactattaagacgggtaaatcgcccaatataaatcccaatagaatccataaataaaagacacgcaatcaaaagcgctgggtagacaccaatggttaatttctctactaatattcttgcaatcttgtcaatgctccagcagcccaaaattgttgaaggcatcactgccaacaaaatcagaaaaagtttgatccaattcattaaatccttacttatcaacaatgttacttcatcataaggtgtcaataaagaaagatgaaatagatctgtcatgagataaaaattatttggtaaaaaaacaagccagagacacacaactaccactataatgtacttttttttacaatacattgcaagaaaggttaattctattggaatatatgccaaaatagtattagtaaagaaaagaaaatagacacttgattgataaaatgaaagatataagattcccagtaaaatcaaataatataaccgaatcccattcattgttttatttagtaaatacatggttcctcctgtcttaacgcgctctcctagccattgtcccactatttagaaagaacagacttcattaattgggcataaacactgcgtccttccccattcaaatgagtttcatcatcataaaagtattctgggtggtctttgctgtggctaaaccagtcgatgatattgacattcttgtagcgactaggaagctctgctaatttttgattcacagattcttgacagccttccggacatttgatagttatccagtatatctgtttatcctttaattgagtaaggatttcatcgattgactcatccgaaataataccatttgtacccagtccgattactaccgtcgaataatcagctaaattgggatgcccttgaagaatcgttgccaaactagatatttgccgtgattctttcgcatcaacggttgcttgcccactaaacgtatcttccaattcttgatatgctccaagcatcacagaatcccctagaaataagatatttcctttttgattgggttgattctctatctttttcagattactgcttaactcttgtttcaattcgttttgatccgcagtcagacggttagtcggtgcaaaaatgatcattccgattgcaacagcaacaagacctgctccaaggtaacgtcctgcttttctttttaaatgcatgaaagaatgaaagccagcaatcatcagaaccgtcatgatcagaaccactaccaattcaattagaggattcatcttaggtgctatattcactaggagaataaacaccgaatagtgaaccaaatataattcataactaattttgcctatatattgaagacggaatttggcgattttggttcttttttccacttctttgtcatttatcaaaacgagtaatagcattgttaatacactgacaagcaatgagctacctgtaaacgaaggcagcggaataaagacagccagagtcaaacaactcatgatgagccaaaacttcgttactttttttgaagaaatgacatcattaatgttctttctattgaaaaaaccaaacatgccaactataaacggataaagtcgagcaaaggtattgtaataagcgatagaaaacggcgataacagactggtgagaatcgaaataatggtaagaagatacataagctgatagcctctttttctagacaaacgcatgactgttagaaagaagagtggaaaaactagataaaattgtaattccaccgccaaagaccagtaatgtttaaatagggacgaatttgcgaagcgatcaaaataagagactttttcgtggatctgccaccagttgttatatccaaagagtaaacttggaagttcacttttgatgtttcctagcattcggatttgaatactcccagctatcagaataaagataagtaaggagaataaaagaaacggataaatccgtttgatccgtttcttataaaagccaatccaggagaactgttttttttgatacgcataggaagcattctttgccatcaagtaacccgaaataacaaagaaaatcgttacgccttgatttcctccttgaaaagaatattgaggcaaatggtagagaataacagcaataaccgcaaatgccctaagaaaatcgttgcctgctgaatagtgtttatccatgtttaacctccggctggccgatgatcattttctccgtaataagtctcattgctggaaggattattcaaaagagtagctaaagacacaaattgataatcttctttttttaaatcacgaataatctcagggactgcagcaatggtttccggatgaatgtcatgcaacaaaataatcgaaccatcatagacagaactcgttactttatcaatgatcatttgggcatctttagatttccaatcttctgaatcaacagaccattggatgatgggacgattgatcaattctgcagcttttgcattgacagaaccatatggcggcgaaaataggctggttttttgcctgtgagtttcttgatagattgatcggtcttcgtgatctcattagtcattccagattcgttcaatgtgctgaggtcttgatgatcataggtatggctaccgatagtttggccatcctttgcgatggctttcaccacctcgggatacatctctacgttctgtcctactaaaaagaaagtagctggcactttttcttttttcaatagttccaataatttaggtgtattgctgggatctggcccatcgtcaaatgtcaaagcgacctttttttatttgaaggaatctcctctgtctctgtagtgctttctagtatattttccaaactagtctctgtagtagccttattgttacttgtcactgttcttgaagaactactgttgcttgttaactcggaggactgggacagattgttctctgtttttcctctagcaaattcctcactgattcgtgcacagccgcaaagtactaacaaaaagataaagccagttatgagtaaacggatctttttcattgcttttcctccttatttgttgtcaatacatcatgaactcttgctatctcttctgtcgaaactgtttgataagagattccattctgaatcaattcctctccgatcacttggtcatgaataattgttggctctttcatcagtttcttcgcatgaagaacaagattggtaatgggtagattggttttgatgttatctgtcaagatatcgataaatgcattccattttgtgacttggttcaattgcgccatattttccaaaacacctttcagtaacaactgttgccgcatttgtctgccatagtcccctcgtggatcctcatacctcattctcgcccaagaaagtgcttcttctggagataacgttagtttacctttaggaaaatcgaatccatcagaactaaactcaaattcattttctacttgaacagctcctacttctttgagaatcttttgaaaatctcccatatcaatagaaacaaaataaggaatttgaatatccaacattttttctactgttttaacggaacagcttgcacctccataagcatacgccgcatttaatttatcctgcattccttggtctgcgatatcaactaaaagatcgcgttcaactcccattaatgtgtattctttcttttttaaattgatatgagcgactatcatactgtcacttcgaccagaatccgttcgcccaaactctccagtatcaacgccaagtagcaaaacattaaaaggttcttgtttcaattggtcgtaatctaagtcatactgctcatctgaaggattcaatttttcgtacacttttgtatttattttatttgcagaatagactgcccagccagtaataccaccaacaaggactactgaaacaaaaagcaaaataagaattattttccgcatcggaacacctcctgctgctaaattaaaggaaaaatgtatctgaaatgtatcgatttagtatttggtgactcgatacatgctcgcttgtagcagcaatgttcgcttttaatttaatattaaaatgttgtatatcacttttagtgaagaagaaagtctactcatccccatttaaaaataacaatcaaaatgaagaataatgcatatattccctattggattttcatttcgattggatttgtttcaaacattttgcttataatatgcaaatatgaataaaaaaggcagaatatttgaataacagcaaacttttgggcatactaattacagaccctaggcgtaaataagctgcgcctaaataaaactagaggtgaaatcatgattgaatttcagcatgtatccaaaatctataaaggcggcaaagtggctgtcgaagatgtcaatctatcctttgaaaagggagaatttatttgtttcattggtaccagtggtagtggtaaaactacttgtatgcgaatgatcaaccgtatgacagacccctccaaaggaaaaattctgattgatggcaaaagtgtgaccgatatcaatccagtagaattacgacgccaaatcggttacgtgatccaaagcatcggcttgatgcctcatatgacgattcgagaaaatattacattagtacaaaaacttttgaaggtcagtcaagaagaacgaaataagacagcagagaaaatgatcgatctggtggaacttcctcgtgaaatgctggatcgttaccctcacgaattatctggtggacagcaacagcggatcggtgttgttcgggctctggcagccgaccaagatatcattttgatggatgaacctttcggtgctttggaccccatcactcgcgattcactgcaagatttgatcaaagatttgcaggaacgtttaggtaaaaccgtcgtcttcgttacccatgatatggatgaagcattaaagttagctagccgcatcgtgatcatgagcgaaggacgcgttatccaattcgatacaccacaaaatattctgcgaaatcctgctactacctttgttgaagaattgatcggtgaagaccgccttctgcaagcaaaaccagacaccacaccagttaaagaagtcatgctcaaaacaccaatcgccatcactcctgaaaaatctttacaagaagcgattcgcctgatgagagaaaaacgggtagatacattattagtgacggataatagcaatgtcttaaaagggtatatcgatgtagaatcgatcgaccgcaatcgaggcaaagtaaccagtgtcggggatattcttaataaagatgttttctatgtaaaagaaaccgccttactgcgagatacgttgcaacgaatccttaaacgcggtttgaaatatgtgccagtcgtggatgctgagaatcatttggtaggaattttgacgcgtgcttcattagtcgatattgtttatgacgttatttggggcgaggaatcctcccttcttgaagcgatcgaatccgcaaaaccagaggaggtctagccatgcaaagcttctttaatgaatatggcggccaattggtcacgaaaagcattgagcatttatacatctcctttgccgcactatttctaggcattgtcgttgcagtccctttgggcgttctattgacacgctttcccaaagccgcttctatcgtgatcggtgtgactagtgccttgcaaactgttccctcattggcactgttggcattgatgatcccgattttaggggtcggtaaggtcccagctattgttgcactctttatctattctttgctgcctattttgcgaaacacctatattggcatgaagaaagtcgattggaattatcgagatgtcgctaaaggaatgggaatgactaacttccaatcgatcattagtgtggaactgccgttagcgatcccaacgatcatggcaggtatccgcttgtcagcagtctatgtcttagcttgggcaaccttggcttcgtacattggtgcaggggggcttggagacttgatctttagtggattgaataactatcaaccggcattgatttttgccggcacaatcccagtgacgatttttgcacttttagcagactggttactcggattacttgagaataaactaacaccagctgcattaaagggggatgcctaaatgaaaatcaaagcgaaatttggtcttttgttatccatgatcattattttactctcaggctgctcctttccaggacttgcttctacatctaatgaagacaccgtagctatcacaggaggaatcacttctgaagctcagattcttggcgctattgtagcaggaatggtagaacattatacggacaaaaataccactgtcattaataacttagcaacaacgacaatcaatcatcaagcaatgatgaatggcgatgcgtctatctctgccgctcgttataccggaacagatttgacaacaacacttggcttagagccagaatctgatccaactgctgcctttaataccgtaaaaaaagaatttgagaaacgttaccatcagacctggtttccttcctacggctttgataacacatatgtttttctagtcagaaaagacactgcagaaaaatataatctgaaaaaagtcagtgatttaaaaggcgttgccgatcagttggttgctggtgtcgatacagcttggatcacccgtgaaggtgacgggtatgatggctttcaagaagcatatggcttttctttcaaaaacattttgcctatgcagatcggtctcgtttacgatgctgttgacaacggaaaaatggatatcgtactcgggtattcaacggatggacggatcgctagttatgacctcgtaatgttggaagatgatttgaatttctttccaccttatgatgcagctccagtagtcgatgacaaattaatcaaagacacaccagaagtagcggacgccttgaacaaacttgctgatacaatctccactgaaaaaatgcagcaactaaattatcaagttgataatgacctgttggaaccgacagtggtcgcagaacgtttcttacaagaaaataattattttgaaggagagtgacgaaatgaatgacatgaatctatttcaacaatttattgcctattttcaggaaaatggcggttatgtctttgcacagtttgttcgtcacttcctgatctctatctatggcgttttattcgctgcaatcgttggtattccactaggaatctggatttctaaaaagatgcgtatggccgattgggtgatccgcatcgccaatatcatccaaacgatcccttcgctagcaatgatctcgattttgatgattggaatgggattaggtgtcaatgtcgttattctgacgatttttctctactcgctcttaccgatcatcaaaaacacctataccggcatgcgccaggtagaccgtaatacactagatgttggtaaaggaatgggcatgacaagttggcaacgactgtatatgatcgaattgcctttatccgtctccgtgatcatggcaggtattcgtaatgcattagtcgttgcaattggaatcactgccattggcgccttcgtaggtgctggtggcctaggtgatatcatcatccgtgggacaaatgcaaccaatggcgcttcaatcattcttgccggagctttacccactgcattgatggcaatcatcaccgacttaggcttaggctttattgaacgtcggttagatccagcaagccgctcgtcgaaataaaggccatttcttagcgcttttataaatatagaaaacaagcatccttacatacaagaaggatgcttgtttttctatatttattaactaattcactcaaagcaggtgaatgcgcttctcgattttccctgagatgatcgggaatcacgcatcatatcctagaggtggttgtttcaaggctcgatccatacaaatggattggcgcccatcgttttgcttgagggacgactggtatgccatcattccatacttgatactgatatggggtcgttttttctcgaacactgctctgatcgctactccaaagatcattctgaagtttggtcgcttttaagttgtacgcttcgtcttccccctactttcttttgggactttttttccgatgaaccccatgccgttcgggtccattcctgataaacacaagacacattcttcagaatctgtctcataataagctgtaaattcatgcccctgccaaaaatagctcttctccatttgctgaatgtctgtaagcatgacaaattctgaagaaatgagactggactctgctgtaaactgaataatctcccacgttcctatgaggtcctctttcatagggatttcaggaattgatttcgcataactaattgctgatatgaccggccaaccactatctaaccaataaatttttctgacatctaaaaagaaatcatcactaaaaggttgtctccgtgcatgatgaataataaataattcattatctgaacgtttgaatatagaattgtggccaggtgcatagactgcagactgttcttcgaattgataactccctagtaatttaacaccaattttctccggtaccgcctcttgttccgacagagacaggccattccaatccgtatagggaccggtaatctctttcgctcttgcaacccggatattataggtttcattcaaagaatcaaaagagacaaataagtaatacatatccgtttctggatgataataaacaaaaggaccctcaatcgcagtatcaacagaagcaggtcgttgcgctattttttttccgtatcccttctcggctaactttccagtgctttgatctataggtgcaatataaatcccgccaaaaaatgatccgtagatcagccaatggtgtcccatacgatctagagcaagatttgcgtcaatggcattatgatcggcgatgcctcgatgcgttttcacaacttctccttgatctacccaaggtcccaaaggatgcggtgctgttccaagaccaataaatgaagtggtactgccaaatgtagaagcggaatagtacattcgatattccccttggtactctatcacttcaggtgcccacaacccttctgcttgactccattctcttgcagattgtggcaattgaggaaaggcctgcttttcaaactgccagtgtatgagatccaatgatgtccggatcggtattcctgccgttttaggttgttgcgtatctgttgaaaataagtaataaacgctgtctcgttcaatgatcgttggatcatgaacaccatttttccagttcatagattcttcctctcagtaatcgattcactttagtttgacttcagtgaacgaaagcagaatcgattcttttctatatttatttagttctttcttacttattacgccactttcattaaaaacaatctatctgctcttgatctttgctacctccaagattaccccaggctagagtttctataactgcttatggcgtaacaaacaggacagtcattgaatgctctgccctgtttgtgcccacattcctgcaggacagtatttttttgataggtttgcccgaaatttataaaagcagccacacttagtacaggtgtgattggaccgaaatgggcaggcttcacaaatttttatacgggactgaacgacttcaagtgcagcaaggtcgttctcgatggctagctgttcttcaatcaacgcttctacatctaccgttgctgctgtttccttgacatcgcaacctttacacgtcattgaattacaccgccaaagatattgtcaatacactcatagcgggtatattgatcgttaattggctattatttgttgtgtagtcttcaaatgattggatcactacgtcttccggatgatcaaaatcattgtgtgcattcattttatcccccacaatatagcgagcttctttgattccttgaatggcagtttcaaagtcaaaactaattgcttccgagccagatactgcgaaattgcagatcgacaggtggagggtatctgcttgtttcgagaccgtgtaggtgatcgtttcacttgctgctccatgactctcgatgcgttcggcatcttgatggactttgtacaaatcaaatacatgatagcttggtgttttgaccatcttttcgccatcagtcaaaatcattgcctgcaaaacattcactgtctgggcaatgtttgccatgtgcactcgttctgcatgcttatgaaaaatgtttaaggtgatagcagctaccattgcatcacgaatcgtgttttgctgatataagaatcctggattcgttccgggttcagcagaaaaccaagttccccactcatcaacaatgatgcccacccgtttttcaggatcatattgatccatgatcgcactgtgacgcgtaatcaattcatccatatgcgcagctttttgacaggtaataatccattctgcttcatcgaatgctaacgcactaccttttttctcccacccttggggatggacataataatgtaagctcaatccatccatcagccaatgggcattcttcatcaacgtttctgtccagtggtagtcatcaacatttgctccgccagccactttgtatattttttgatcaccgtattgacgaacgtaagtctgataccgacgataaagatcagcataatattctggacgcatatttccaccgcagccccaattttcatttcctacaccgaaaaatttcatgctccaagcttcttcatgaccattttctcgacgccaatctgccattggagaaattccgttcatggtaatgtactcgacccattcagacatttcttggactgtcccactgccgacatttccattgacatatgcttcacattccagttgtttgaccaattcaaagaattcatgtgtcccaaaatgattattttcagtcacacccccccagtgagtattgacgatcgtttttcgattttcttttggtccaataccgtctttccaatggtattcatcggcaaaacagccacctggccagcgtaaaactggaatcttgatattcttcaaagcttccacaacatccgtacgcatcccattcttgtttggaataggagaatcttctcctacgtataatccttcatagatacaacggccgagatgttctgaaaagtgtccgtaaatatatttgctgatcgttgttcctgattttgtatttagaattttgattgtcattgttatactcctattctttgattccccaaatggactcattattatcgccaatcgttgagaacgttaatttttgctgttcgaattctgttatatcctgagttaataaggtccctttgaaggtagtatctgcgaaggtcattgtgatgtgtccggcatcgtatgtccaagtcccggtcagctctccagtgatgtttccatctttttgaagctcgatcatttgtgtttttagcatggtcgttccattatcggtgccatggttaatgatttcatagcgtccgataatttcatctgctgtcaaagcatctgctacttgttcattgcctcgatactcatagggtgctggaactggccagccctcctcattcatatacattctgttgactcgcacttcatgggcttcggttccattgttaaagcgcgtatgatacaccaaggaccactgaccattctcatcgatgatcgccgaattgtgtcctgccgctcgataccccatttgttgaaacgagaattggtagttgccaatcaatttgataccatagtttgaattttgctctccttgttccaaaattggactatttccttgagcatcgaggtaaggtccttcaggtttttccgcgcgaaagagtcgcatattgtaaccaccttttgctgctaaaccaccgtaagtgacgaataagtaataataatcggttttctcatcataaacaatataaggaccttctcctgattggtgatagccgccaaaaagcttgattccgaaataacgatcaatgatacgaccgtcttccgtcgtgctatctttcccaggatacattggttttccagtggctggatcaacttctaataagaagataccgccagaccaagaaccataggtcatccatagttttccctcttcatcataaaacaaagctggatcaatggcgtttggcgcataatcggtgttatatgtcagaccatcttcgatcgcccagttttcgctgaaaccgctgatttttctctctttgatcaatttcgccaaacgggtattttgatagttagtattgcgctcactaccatctgtcgaatctttttctgtaaagccagaatagattacagtatccgcataactatagggaccttcaatcgttttagctacagctaatccaatcgctgaacggcgccaagtagaacttgcggaatagtacaacatataggcccctttatcaccatttgaccattcataatcagcattccaaatgacatctggtgcccaaaggctgtaaccaccttgtgaattggcatcatcgtagcctgcccattcaaaagtttcagctagattttcttttgtgttaccatagatcgtattgtcttccattgattcatattcgtaagtgaaaggtacttcccaagtttgtaaatctgcggttttcgcctgagcgagatgcgaaccaaatacgtaaaacagctcttggtcaccaacatgaatagaagtaatcgatgggtcatgaatcgacactcgattttttgtcgttgtttcccactccttttgtgaaagttgctcagcggcgtctcctgtttgacagccagcaagaaaaaaactagtaaaaaaaacggacatggttaaacagagcatttttctttttgtattcatttttttcctctcttttatcctttgactgcaccgggttcaccaaaatctggtagtccatttttatcccaagtaaacggttggacatacgcatgtcgattgggattttctaaaggattactataatcatttatttctggtcttgcatgatacactaagatctcttgtttcccttcctcatcgactgtaaaggagttatgtcctggtccgtagagggaattttgttccgaactcgaaaaaaccggttccttcaacttatgccaagaatatccattcaatagatcactatcctcatctgcccacaacagtcccatcacatagttttcatccgtcgcacttgctgaataagtaatgatcacttttccattcctaatcaaggcagcaggtgcttcgtttactttgaagccgattttttcccattcataataaggaatactcagaagaatctgctttcctttcaaagtccaaggattttccatctctgataagtaaagattagaattgcctggaatatttggatccgcttgtgcccagacataatacaatcggttcctgtgttcaaataccgtagcatctaagctgaaactttcaaattgcgtcttgatctgccctttttctacccactcaccttcaaagggatcttcattcgcattttcgatcgcaaacatccgatgatgatgctgatcatttctaacttctccatgatctgcagcagcaaaatagatgtaccattttccctgaataaaatggatctctggcgcccaaatcagctcactcatggggccttcggcatgagccgtccagatgacttttacttcaccgtcagccagtccttttaaggttttcgcacgtcttaattcgatttcctgatatcctggttttgatccagtgaaataataatatccatcggtatgcttgtatatccatggatctgctcgttctaatacaattggttccaaataattttctgccataaattctacaccttcttaaaaatatccatcttcagtttttaacgttcttaaggctttattttttgatatatacaaaatagttgcgagtaaatagaatacaataccgatgacatcatagatgactaaatgaatgatgacacaggcaatcatccatctcatagttcctttattgatttgtttatctctcatatttttagcgttgatccaactgatcacacccattaagatagtcgctaaagcaacgatcatgactacttttgagatcatacctacaaggcttgattgcaaatattcatactgatttttattttgaaaagcagcgatgccttgttcttcaaaccaaggataatagccaaacatcgtaactaacccaatcaacacatcccagacagcactgacccgtaataaatttctttctatttttctgttcataagtttcactatccctttattcccgcatttaagttcatagattcaatgaaatatttttgggcaaataaaaacagcagtactgttggaataatggcgatcaatgctgatcccattaactgtccaatcattcgataattgccataaatgtcttgtagtaatagcaaaccggctgtgatcggcattttactgacatccgtatacacgatcaccggccataagaaatcattccaagaaccagtgaaagaaaagagtccagcaacgatcagaacaggtttgatcaacggaacgatgatctcagaaaaaatcgtaaattcatctgcaccatccattcttgccgactcgtcaaattccagcgggatgcctttcataaactgtcgcacaagaaaaatattccccatccctgctaatcccggaatgatcatagcaagtgatgaattgacccaaccaaatgtttcgataattttgtaggaaggaatcaaattaactactccagggaacatagaaatccccattagaatataaaagatacggtctcggtatttgaaacgcattctgccatagccataagctgttacagaaacaacaattaccactaagatagtatgagtaacggcaataaaaagagaattccacagccattgcatgattggtgcagtagaagtattagccaagattgctacataattatctaaaatccagttaactggcaatagtcgaaatccagtagacacgatttcagtttgggaacgaaaagaagttgcaaaactaaaaatcaatggaattacccagataatacataaagtgattaaaaataaatatgcgactagcatactaggtatatgtttcttttgtgtattcatctttttgcccccttaagtattgtttttatctaatagaaaatattgaaatacagatacacacataataattagtcctaatatgacagccattgctgaagccatccctgcaattgattccccttgactaaatgctaatgaacgaatgtacatcattaatacagtagtacttcgatttggtccaccgccagtcatcatcagcggttgcgcaaaaacattgaatgcaccggcagttgtcataacaattgtatatagaagaggaaaacgaatagatggcaatgttacattaaagaatttttgaactggtccggcaccatcgatttcagcagcctcatataaatcttcatttactcctgccagagccgagcgataaatgatcatattcccaccaatcgctccccatatactgacaacaaatatcaagatccaagcatatggctgtttagaagcccatgaaaaatcatatccaaaaatattatttacagcgcctaatctcgagtgaaaaattagtgaccatatcagagatcccgctgatactgaaataagacctggaatatatagaattgcttgaaaaagacctttcattttcacttttttatgttgtagagccgctgcaatcatcaaaggaataatgatctgtaagggaaccatgatcaaaacgaaaataaaagtatttttcaaaccattccaaaattgagtgtaaaacgtggaagaactatcaaataataatgtcttatagttgtttagacctatccaaacaggatcagaaatcaaattccactgagtaaatgaagcataaacaccatagagcgttggaatacatacaaaaataataaagagaaccatatgcggtccaataaatgcaattgaagcccaattaatgttcttttttttcattcctttcattcccttcaaaaaatccgaaaggggataattttatcccctttaatttatttcgccacttccgcaattttgtcttctacatactgctgcatcgtagctaaaccttcatctaaatctagttcaccataagcaatatctgtacaatagacatctagtgcttctaaaacataagagaaataaacatagtcaaagatatatagtgtgtcttcttcttctggtgttgatgtaaagaaagattgtggatattttttataatcatcgctttctaaaacatctttactggcaacgatttgtccagctttagcccattcaatcgagttagtacgaacaaactccaagaattttgcgataacttcctttttttcttctgttctagactcactcttcagcatgccaaacatatgagaagctgctcggttggttgcgatgtcatctgaagtcgaataaatatttgttacaccccaatttagcccatcaacggcatcgtgagcggtggaagtccaagtaccatctgttgataagagtacgtttccgccttggaacatcaaatagccatcttctccataaggagtcattaaacctgcatctgttaacgcttttattttttccaatgcttctttcatttccggcgtattcaccgtcgggttcccagcatcgtcagaaatcgcgccgcctaagttacggatttgtgctaagataacccaagaaagcaaagcattattaacaacataatcgccttcatccatttttcctgctaaagacatcatttcatcaaacgtcacgatgttgtcgtctaaccaagaagtgacattgtatttttctaaaagatcttgattgtaatacattgcactggcatggatatctaatgggatcgtatattgagtatcgccgatttttcctgcatcccaagcagtatctaaataattgctctcttctaactctggttgatacgaaatcaaaggctcaactgtatcaagaatgcctgaattaacaaactcctcaactttataagaatgcattagtgtcaaatcagggataccatttttagagctaacaactgtacttaattttgtatacatatccgaagtaatcacatgatttattttgtaatctgaatcagattgttcattaaattcatctacaatcttatccatataggcaccgtcatcaccagtgagtggggaccaaaaattgattgtatatttttctttttctaaagcgcggtacctgttaaacccaacgagagcaactgcaactactgcaaccaatgcgccaataataataagtttctttttcatgatttaccctctttcattgaaattgaattgtaatctttgaagccaatagccctatcctcctcgtcaacactagttaaacaatcatgtataatttaattacttatattcagcgtttgcaaacactttcaatttacaactaaataataactttatttgtaatcgctgtcaacaatattttaattaaacaactctaaataatatatcaattaattaatatatatattaatagtaactactataaataatactatttacacaaattaacaaatatgttaacattcaagtaaatcatttataactataatgggggtgaaatgatgcaattagaaatcaatcaagaagcattgcccgtctatgaggcgttagctagtaatgtacggatcaaaatcattcaactacttgcaagaaacaaaatgaatgtgaaagaaatcgcacaagaattaggattaagcagtgctatcgtcacgatgcatatcaaaaagctagaagaagcaaaaattatcaagacagaacgtgtcggtcagcgaaagatatctagtctgagagtcgatcatatcgatatcaattttccagaaaaaatctttaatgcattcgatacgagagaaacgtcaattccaattggtcattatacaaattattcggttgaacccacttgtggattagccacgcttgctggttttatcggtccagtagatgaacctaaattttttatggaccccaatcgaatggatgctcgcatcctctggtttacgaaagggtttgttgagtaccagtcacctaattttctttctctagatgagaaactagagatgatggagatttccatggagatttcttctgaattccctttttctaataataattggccgtctgacattacctttagcttaaatggcatcgagcttggaacttggacaagtcccggtgacttcgccgatattcgcggcaagtatacgccagattggtatcctgataacttaaatcaatatgggttattgaagacgattcgaatcatggatcatgggacttatatggaaggagaacctttatcagacgtcacgatcaaggatattcctgcttatgaagatacttggcatttaagagtcgaggtaaaagaagaggctgaaaatatgggcggttgtacattgtttggcaaagggtttggaaattacgatcaagacatcaaaatcaaaatgttttacagctaaacgtttttaggaatcacaggcacactctctcatcatttttgatgtgcggtaaaagattccttcgctgaaaataagacaaaaaagaccatctcgctcgatattagagttagatagtcttttttgattataaaacttaatctatttcttcaaatgataactgtaagttcctacgacaatgttttcacgccatgataaacggaatcttagacgcagacttgtttggttgtgtaaaatattttgccagcgacgacgtggcacgaactgtggaatgataactgtcgtcgtataattgtgtttcgttgcgtttttgctgactagatctacataacgaatgattggattttcaattgaacgataagaagaatgcactacagaaaaacggacatccgggaaattttgtttgaactcttgttcgatttctttttccttcttgacatcttcatctaaagatacgtgcattgcaactacataatctccgatggattgtgcataattcaaagccccgatatttacacgggtcacatttcctactaatacaataacggtattgccatcatatttgtggagtgccacttctttttccaaacgtagctgctcagcgactttcttataatgatcatggatcttataaaagacaaacagtaggattggcatgatgataaagaatggccagatgtcacctagacgaaaaacaaacaagatcgcaatgatcgcaaaagaaatcaacgctccgacgatgttggccaatgatttcaagaaccatcctttaccagctttcttccatcgaactaccattcctgtttgtgagagcgcaaagggaatgaacacgccaatcgaataaagtggaatcaaccgttccgtcgatccttggaaaatgaacaatagaacgatcgaacctgctgccagcgtaatgatcccattagaataacccaagcggtctccccgatcttgatacatatgaggcatatacttatctttcgctaagttataggctaacactgggaatgcggagaatccagtattcgctgcaactgctaaaatcaaagccgttgcgaactgcagaacgtaatacatgaatccgtgaccgaagatcgcagctccgatttgcgaaaggaccgttacttctgcttctggaacgattccataccaatagttgatgaatgtaatccccacaaagaagaaacctaggatcgcagccatgatcgtcaatgttgcagctgcattttttgctcgcggctttttgaaaaacggcacagcattactgattgcttctacccctgtcaatgaagaagaaccagaagaaaaagcgcgtaagatcaatgcgacagaaacccctggcacaacagcacctggtaaggctgtggcatttaatggctgtaccccagtgataatattaaataatcctacaagaatcaagatcgtgatcacagcgataaaggtgtatacaggaaccatcaagaaactcgcagattctcgtagcccccgtaagttcatcatcatgatcagtaaaacaatagtgatcgagatacccacctgatgcccatatagagcgggtacggcagaagtaatcgcttctgccccagccgataccgaaacggcaacagtcagcatgtagtcgatcaataaagagccgccagcaatcaaacctgcattcttgcccaaattctcactactaacgacatacgccccaccaccatgagggtacgcatgaatgatttgacgataggataaggtcaatgaaatcaacaagataataacgaatgcggcgatcggtagtgaataccagatagcagcagctgacaaagcaactaagacaacaacgatttgttcggtcccataagcaatcgatgacaatgcatccgaagataacaaagccaacgcggctttccttgtcaatttttgttcatcattctccgcggatttcaatggacgtccgaccaacaaacgtttcaaatattccactttcttacactccttttttcatgaaaaagatcataattgcacatacaaaatttctttgataattactgaattaacaagactgtatgctactcctgaaaccgacaaaagtcaatgaaaatggcatgaaaaatttgaacaaactccctcttctttttatcagaattcgcaagaagattcaagaaaagcagatagaacatcgtgccctatctgctcttgattttttaatggaaaaaatgactctttttcgagacattatttagtttcttagttacatctgttagataaggataagcccatgttcctatgatgccaaatacaataaacaacagtgacaaaataatcaactgaggaatggcgtttggccaatagatcccgccggctgattcccttaacagattgactgcatgggtgaatggtaacagcggattaataaattggaaaaatttaccagagacttggatcggataatttccgcccccaccagaaatcgatagaacaaggataatgatcgcgatccctttcccgacattgccaaacagtccggctaagacgtagacgatcatcataaatgctagtccaacgagtaatgcgaacaagacgctgtataccggattatgaacatctactcctaataagaacatatttcctagtgtaacgatcaagctttgcgcaatggccatagttaggaaagtcagcattcgagcaacgaatgtttctcgttgcgtaaagcgttctttatctttcttctctaaatgatactctgttgtagccacacttgacaacaataacgccccgacccataaacacaacgctgtatagaatggagtgctggcagaaccattgttggcaatcggatagatgtcatttgtttgcaattcaactggttgtttgaagaaatccgcttctttagttgcatcaagcttcaacaacttgatgatctcgcctagatcaacttcactttcacctttgcgaatcgcattggctgccttatgaatgcctgttttgatatttggccaatcattattgatcaaatcaactgccgcattcaatgctttttctacatctggcagtttctcatcaaccatgttcatggtcgaagtgatttcagctttgatggttggccagtcattttgtaagaaaccagccgcaatccctaacttatcttcaacgattggcagttcattgttgtaaagatcggcccctttgttgatggctgcgacgatctcatccatgtgaccattgagcatcgtattggcatcatgcaactcttgcttaatagcaggtaattctttttgatacttttctaagatactgatagcattgctgaccacatttttggttgatgccaataaagacttgaagtcaatggcttgcgcttttttcaatacatcttgagctgtggtgatggtggtgatcaatttagtcaacacattgtcgatggtatcggtaatattcgtcacattaatgccttttaaaagatccgtaacattttgtgcagcagtgttgacttcagttaaatagtcggtaatagcctctgtattcccatttttgaccaattcgcttaaatgatctagccgcgaagaaagatcccccaagagactttttgcattcgtcaattgattaatgatccctgataaatcggatgtgttgcctgagttttgaagattcgttaagaaagtaatcaagccatccagcgctgcttgttgccgttgaatattttgttggaaatcactgatgaccttttggatgttttcccgttcttggtcggtcaattgattgtcagcaattgcttgtttgattgtattcgttaagctaactgtcgtggtagcgacttgactgatggaatcaatcgttacttgaacactattagaaatacttggtagcgcatcttgtaactgttgggcaccttctttcgtcgctgaggcaaagtctgttgcttggtcccctaattgttggatttctggcaatgcggtttgtacttgatcaatgatttgcagtccttgtttagctgtatcaataccatctgtcattgtactagcaatagaatcaaaatcatcatcgatcatttttaattgcttgccggcattttggatctcagggatctttttctgcaatgtcagaatgacactagcttgtttttttaattctggcagcttgtcattcaatgcgatcagtttatcccccatttcatcgacctgaggaatataatccgtaaattcttcggctttggcgattttgtctttgatttccgggaacttgtcatgcaaatcaacaatttgcttcgtgtaactatcaatggtgtcaagattgccatcggtctctaaaatcatatttttgactttattgatactaactagatttgaatcaatatcatacccgatttcgttgaacactttgactaatgtagaactagcagtttcaataaagttctttgagatctgttcttggagactgcttgctcccttgtcagtaatcttaggtgcgatagcattgattttttggttactgtagtattcaattttcggtttaacgatcgtaccgctggtaaaactgaccagatcttttgaaaaatcagcaggcaagtaaattcccgcgtaatatttacctgatttgaccccttccactaattcttttttagaatctagaaaatgccaacctaactgtttattttcatgtaaagagtcgatcacttcattcccaatcgatagctctttcccttggaattctgcgcctttatccgcgctgtaaaccgcaatgggcagttcactagtgtttccatatggatcccataatgctttgatattgaaccacgcataaagcgagggcaaaatcatcaaagcaatgatcaaaaaagcggaaatcggattactaaaaattcgtttccagtctaatttgtataaataaaacacgtttttgattttgttcattttctttcccccacttttcttcgtcgaaggataatttaccacgttttttgtacgccgccaatgggaatgattcccttgatatcagccttttgacaaaaagtaccatttgtcaaaatgaaacccctttacttttcgcgtaatttcccttattattaatcttttctttaactttaacacgactgcttttggcagacgaacaatttgtttgctaaaagcaatcataaaaaaagcaccattgaccgtttcccttgatacgatcaatggtgcctgttctagtttgtcaactgctcagtggccaatagttgataaacgtactcaagagaagtcgtttcggcataaaggttcaaacctgctttttcatcagctgaaaaatgatgagtgaaactttgatccggtatcaacaccacttgaattcctgcccgagttgccgcggtagctcctggcaatgagtcttccataactaaagctgattcagaggttcgtgctgcttttttcaatgtcagcaaatagggagccggatctggtttgtgtgctgggacatcgtcaccaaatgtcttgaaatcaaatgcattctgcaattcaaaatgatccagtagtttttcacctcgaaaagccatcgaagaagtggctaatgctgtctttaaccctttttctcgtgccagagccaatgtctcacgagcaaatggttttggctgcaagtttccattgagcaattggtcttcaatgtacccttctcgttcttgccgaagttcctccacacgttgaagaccaccaacttttttcgctagtaaggttgctgtctgttgccaactttgcccacgccaagcaacgatatctgctgatgtgatcggtagatggtacttttcaaaaagtgccaaccagccttcatgatagactctttccgtatctagcagcaatccgtccaaatcaaaaatcaataattctttcatagactctttactccttctctccttcatactcaagcagtttcaatataagtattttaatcaagacatttgacgattcttttcggcagctgcatgaacagccttcatcaccgcagcacgaaagccattttcttccagtgtttttacggcttgaatggtcgtaccaccaggagaactgacattgtctttcaatacaccaggatgttctttggtctccagcaccatcttcgcagcgcctaaaactgcctgagcagcaaattcataggccatttggcgggtcattccttcggcgactgcgccatcggccaatgcttcaatgaacagataggtatatgctggggaagaaccgctgaccccaatcacagcatcgatcatggattcaggcacttgagctgcttttcccatgctttcaaataatttttggatttctgcagcttcctctacggtcacatgcggattgttactgatagacgtcatcccttctccgactagtgccggagtattcggcatcactcgaacgatcttgcgctgacccaaaacttcttccatctgcgcaatcgtaacgcctgctgcgatcgatacaactaactgttgttcatttaattgcgcttttagatcctccaataatttaggaaacacaaacggtttgacagctaaaatcaaaatggaagcagctgcggcttcagaaagttctaatgtaggggtgatccctaaatcttgttccaactgtttaagtgtcggttcataccgatgattgtagactaaaatttcctttggttgatatagttccgattggatcaatcctttgataattgcttttgccatatttccggccccgataaaggcgatggttttcataacactcactccttctaacatttatgatcctatgttcgctgtttcttgtaaaaaaagcctaatcaagagattaggcttcaaactcgatcacataaggatgcaatgctgtattatagatgccctctgtatattctaccacttctccatgcagatcataagagcgacggacgcgctttaaagcggaaatctctggtgtgatcagaaatttttgttgttcctcattcaacgtcagtcctgcaaatgaatcttcaaaggtatcgatcaccatccgatgttcatctaaaatacggtacagtgatttttcttccaattcttccatggcaaggccttttaacaatttgggcaaatgatattcataataaataaatggttgatggtcaaaatagtacatgcgccgcaaacgcatgacttctctgcccatcaaagcagaagctggatgatcttctgcgagctcgactaggttaaaatcaagatttttcttggtatattctttgccggttttttctaataactggctgaaagttgtccctttagacaacttgttataaggtcgattacttaaaaccgtggtcccgcgtccactgcgcttttcgacatattcatctgctgctaatagctcgattgctttgcgtaccgtgattttactcacattgaaggctgcttctaattcggtttctgtcggtagaaaagaaccaacaggatagtgtccggacatgatgtcttctttgattttatctgccacatcacgatataaaatatgtttacgcttcatttctttcctcgcctttccagtcattgattctctctcaaaaagaggacttgcacgttactcatcaaaacccggcacttcttcggctgctgcttcgatcagcaccttccgaggcttactgccttctgaaggacctacgaccccttggtcttccaattcgtcaacaagacgggctgcccgattgtagccaatccgaaagcggcgttgtaataaagagacacttgccgtctgcatttcgatcaccaatgctttggcatcatcaaatagttcatcctgtggttgaccactgctggtacttgccgtatcttcttcggtaaccatcattttctcttcgtaattcgctccctgctgctcggtaacaaacgacacgacccgttctacttcgtggtctgagataaaggctccttgcacccggattggtttattctcacccataggcaagtacaacatatcgcctcgtccaagaagtttttccgcgccgttgctgtcaatgattgtccgggaatcgaccccgctggaaacggcgaacgccattcttgaaggtacgttggctttgatgattcctgtgatgacatccacactaggacgttgtgtcgccaagatcatatggatccctgcagcccgcgccatttgagctagacgaatgatcgcatcttctacttcattacttgcgaccatcatcaagtcagccaattcatcaacaatgacaacgatgaatggcaagattggtcggttttcaccatcttctaaatttttattgatcactagttcattgtatcctgtgatatttctaactcctgtcgcagcgaacttctcataccgttcttccatctctttaaccactttttgcaacgcttgcgctgctttccgagggttcgtcactaccggagtcaatagatgaggaatgccattatagacattcaattcaaccattttcggatcgatcatcatcaatttgacttcgtggggttttgcccgcatcaaaatacttgtgatgataccgttgattgcaacggatttcccactaccagtagatcctgcaatcagtaagtgaggcattttcgttagatcggccgtttggacacggccagaaatatctctacccaaagggacttctaacaacttatcgggatgatccggctgtgcttcaatcacctctcggaaggaaaccatgctgacagcactgttaggcacctcgatcccaatcagtgattttccaggaatcggtgcttccatccgtacatctttagcagctagtgccagtgcgatgtcatctgttaagccaacgattttgctgactttgactccgactgctggctgtacttcaaatttagttactgctggtcctaaactagcttttaccaccttggcatcgacgccaaagctttggaaagtcttttctaaaacaccaatgttttgttcgatttttttgtactcgctgctttgatcggttgcagggatcgagtccaacaattcagcggacggcaactcatagtcgcgattttctgcttcttcggaaatttcaaattccaatacttcgccatcatcttccatttcttcaacgctttcttttttctcctgtgccgaagccggagaggatgatgcagctggcggtgttttgggcaattcttgaaaatgatcgattggcacaaaacttaactgctctggttcgatttccgacaaatctggttctgattgggctgctcgctcttcttccgtgaagggacggacttgattcttttctttgatctcagccaaaacagcagaacgctctgcttcttttttcgctgctttttcagcagctttttgcgcttttcgttcttcgcgggctgcttgtttttcaggtgatccttccaaccattgctgaaccttttcaccagcgtgctgcagatgctccaacaactcgtgactgctcatcttactgaacaaaaagcccccgatcatgatcatcaagacagctaaaatgtaactgccgatctgggatacaaggaaataggttccgcgatagaagaatgcgccgaccatgcctcctcccacattttgtgaaacttgactgcggcgaatatcatccagcaatgtcgaccaagtcgtctgcaagacattcggcgattcattcatgacattattgaataaatgcgcatgcaggatcactaagatccccaaatagatcagcacacagccaaccactcgacgtaaactcgtaaaacgagcttctgtggtcttgattgccaaccatcccccgtaaacggccaatgcgagacaaagcacttgatacgtattgcctccaatgatacgaaagccgttagcgatcagcgttcctaaaaagcctaagtggaaaaaaccaaagatcgaaaacaagatgaaaagcaagccgatgccgactagaatcagtttctcttgttgtttttgttgtttttttgttttgcgtttcttcgcgcgttttttttgcgccattcttatccctcttttcgtctctacctattataacgaaaaaagaaggcgaacaaaagttttcctgtcagaaagtttactactagaaataaaagatcccactaatgaaaaaaagaccgctccataaatccatcaaacaaagacgatctaaaggagaaaagacaagaaatgcttcttaaaaatctctttagtaagactacagttaagctaccttgcacctgttcatcaatcgcttcatgccaggtagctactgtgatcgtttttgttgtggcttatgtcgccgtcaatcgtttttcatttattcaggagaaacatcttctccaaaccatttttcggaaatctcagcaaatgtgccattttcttgcagtttctttaatccctcattgattttatccgccaatgcttgatcgtcttttcgtactcctactgcaaaattttcggctttgaagggactttcaataacattgtaatcgtccgcttttttcgtctgagtcaaatagtactccgcgtagacccgatcgatcaaaagaccatcgatccgaccattttccaaatcgataaacgcttcgttgaaactagcatataaagttgcttcattatcggcgacaatgtctttcaatacttctggttgattgttgaaggtatcatagccagaggatccttcttgtgcccctagaactttgtctttcattgcatcaaatgaagtgatgttgctgtctttggcagttactagaacctgcttgttttccatataagtatcgctgaataatactttcttttcccgggcttctgtttttgtgtagccattccaaatcatatcgattgtaccattatctaattctgtttctttcatcgaccagtcgattgcttggaatttgactttggttcctgttaaatcaaaaacggcttttgctaggtcaacatcgaaaccaacgatgtccccttggtcatcttgaaagcccatcggtacaaaggtatcgtccaacccaacgatgacttcctctttgtctgcagcactttctgctttctcgctactattgccacatgcagcaaaaagtaataagctggctccggctaacaacgttaatccaatttttttcatttttcttcctccttagttcccttcaacttctaataattgatcggcaatattttttgcaaaaaccagatcatgggtaaccacgatctgagtaacgccctcttttttcaaatctaagatcagtttttcgacttgctggcgcagacctggatctaatgcactcgtaggttcatcatacgccaatactttcggatccatcgccatcgcccgcgcaatcgctacccgttggcgttgccctcctgaaagttggtaaggatattgcgttaaaagttcagataatcccaactgtttagccaaagcaacagctttttcggtatagctagctttgtcttgtttcaataccatttttggtgccagtgtgatgttatcgaataccgacaaatgcggaaatagctgaaagtcttgaaaaacgacaccgactacttgttcttgttttttcgtatccgtgggatcaaaaggttgtccatctagtaaaaaagttcctgaatcgatggtctccaatccagccagggtacgcagcagggttgtttttccaccgccagaaggtccgactaccgctaggatgctgccttcttcaattgtcaggtctaagcgatcgataacctgcttgtcgccaaatgcttttgatacttgtctcagttctaacatgttcctacgcctcctaacggtaataatcgagttttgtttctaactgtttcaaaatcagtgtaaaaataccagtcatcattaagtaaatcagcgcaacgcccagtaatggtaccaacgtgctgtctcgttccattgcgattttaccgatacgcataacatccgacaaacctaaaatatagacaagcgaagtatcttttactaaattgatcacttcgttccctactgaaggaagcgtgatcttgactacttgcggaatgataatcttgcgaatcgtctgtaaaggtgctaggcgcagaacttttgctgcttcgtattgccctgcagggattgattggatccctccccgaaaaatctcggcataataagcggcataattgataataaaggcaatcagtgctgcttcaaaccgatcaaagacaatgttcaggatcggcagaccataaaacacaaagatcagttgtaacagtaaaggcgttcctcgcatcagccagacatacacttgcacgattgctttcaagatccgtagtcgactagcaagaataaaagccaagatgatccctaatggaatcgatcctattaacgttaatccaaacaatttgattgtgatccctgccccagaaagcagttgcggcatcacacttactaaataatcgatcatttctttttgcctccttgattttgcggcaatgactgcttgcttgatttacaatcaccaagcaccatcttgccgtgtttccacttgattaaaatcattaaaatgaaaggcgcccaacaaaaaacgccctccggcctaatgccagaggacgtttaatacgtggttccacctcaatttgtttttccttcacagaaaaaacctcatgcagtcagttgatggatttgctgataccgccattaaataaaaaaagtcctttagccattacagctaaaggacgttatcaacgcggttccacctttgtttatcagtgcttcacagcaactgatctcagaaagtcatcaaacaatgactgctgctataacgggcactcccggtctttcctactcgattcagaaaaacgactccaagatgtggttcacaagtccttgttgtctcttctcaccagccagagactctcttaaaacgaagaaaccttgctactcttcttttcgatgtctgtttcattaagttgtttattactttatacgcaaactgaaaaaaagtcaaatactttttttcagttttttgatcggaaaattcattttcacaaaataagagacgaatagaaacattctatccgccctaaatgcattttagacttcgtaatgatcagtacaactttgtattccctctatggtactttcagttgaacatgatagcgatagcggtccccacgataataaatttcagcatattcaactaagcgatttttgtggtctttagtcagacgctcgacatataaaagtggtgtattcatttcaatttttaataagttggagagttcttcatcagacacaactgactcaatggtttcttgtgctgttgttactataaaaccttgactacgcataatttgataaagtgatgcatgtttgtcagcaagatctttttcttttagctcaatgtatgatggacaatatactcgttgaaatccaatacattgatcatccacgtagcgaaggcgttcgtgtttgctgacctccgctccttttggcaaatctaacttactacacaacacctcatttgcttccaaagatgtatttaaagaaattaactctgaatgattggactgcagtttattttcttccgaaaaacttagaagggtttgtaattgcagtaattctttcgtactgagtacaattgtacctacaccatgaattcttttgataaaaccttcatctactaaaagttgcaaggcatgacgaactgtaatacggcttactccgtatttttcttgaagttccggttcagtcaaaaaaggttgcccaactggatattttccttcattgatttcttttttcagctcttcataaatcgagagatattttacctttggacttatcattttcattcaccacatttgctaaagattcagccaaactagttaaatcgtagctattcgctgattgaacatcacgaaacagtggcgtaaaacgttcatcatctggatcaatcaatgccccaaccatggatcctacaattgtcgcaatcgtatcagtgtcgtatcctacattcactgcatctatgatcgcattaaaaggatcttgtttgtttagggcgataattccaaacgcacacggaactgcttctgagatatggagcccactaccgatgatttgagctagtcgctgtagtttttcttcatgggtaccagattcattaactatagtatacgctagtttcatgcgttcaacaacgctgggaccgccaacttctcgggaataaactttgcctaattcttctccccgacaagcgccataaatccctattgctactaattggtccacagttgcatggtcacacaaagaggctgacactgctgccgcaactgcagctgctccagaaatagccagtgcattatcatgagttacttgcgttataatcaacgcttcttgaatagctttttcaatatctcctgggtttaatatccctgcaggtgcgattttcattgcagctccgttcgtagcttttgaagcatagtctacagccatagctcccggtaaaggcgccattttttgatcaggatttttatacattgcaatcgcacttcgcgtagttggacctgcaaatcgatcgaagtaccatgtattttctgaccatttcaagatggctgtcttcactgtttcagaatcaattactcctctattttctataatactgtgacacaacgtataaatttgcgaaaaatcatctgtgacttgtccagcttcattccctaatgcaaaagcaccttcctctggttttaaaaaggtagaaactttgccattgaactttgttctaatttgatcaaaagtaagattttctgttgcagctcccatagcatctgcaatagctgctgcccccaatgtaccttgaatttttatttgtaaactcatataaactatctccattctcttattctttatttcatttcagcttctgggtcttttatacctaaaatgattgttaggatcattccaccaaaaaatgcaatcaccaaacccacaatgtacgcccaaagtgtaggacccgcaaaagctggaatggtggttaatcctccaaatacaaaggcgttaccaataacattaaatgcacccataaaagctccacccattgcagcaccaagacagccagcaatcaacggtgttttaaattttactcctagaccgtaaatagcaggctctacaattccagataaaaagacagaagtaattgcagtcaaagaaaagttccttaatttggtattttttgatcgtaagaaaactgcaaatgctgctcctgccatcccaaagtttgcagttacgccatacgcaatgaatggtgagtgacctgtgctagcgatttccggaataataaccatggtatttggtgcccaatgaacaccaaacatgatcaaaatattccaaatgccacctgtaattgcccctgtaataatctgattgattcctgctaaataatttacaaatccagcaataccaatactaatatagttacctaagggaccaaaaatactggcagttacaggcactaacacaaacaaaagaacggttggtatcaaaatcatatgcaaactattcggaattgtttttttcatgaaatgttccattttcgattgtacccatgttgtaaaaattgcgggcagaatctgcgaagtgtagttaaagactggaactggtaaaccaaagaaagaaatcgtattgcccccgtccccttggatcaaattaataaagtctggcataatcaatgcaccagcgactgcaatggcaatataaggactcgttttaaatcggtttgctgcagttaccgaaactagtaacggtaagaagtagaagacagatgttgcagcaagtgtcaacatcaaatttgtcgagctatccgtagataaaattccgacctcatttgcaagaattgtaaatcctcgaagaagacccgatccggctaataaaggtaataaaggcgagaaaatactcactacgagttgaacaaactcatttattaagctcttttttgtctggactttagaatttttttcattggtcgtctcattattttctctattcaatacttttaagaagtcttcataaacttcccctacattcgttccaataattatttgatacccggaatctttattgactactcctgtcacaccatccaataattctattttttcactttgaactaactcacgtttcttcagacttgggcgtaatcttgttgcacagtgagtaattgactcaatattttctgttccgcctagatactctagaatctgctgggctaacctttcatttttcatgataaatcccctttctataatgaattagcaagtcgttatgacgtcatatcaacatctaaaatatacccctaacgcccttgagtgtaaacgattacaaaagaaatatatccaaagatttatttatcactcataaatctgctttcaagatttagcttttttgaacacgttctattgaaactattttttaacactttagttaaaaagaggatagaaagaaactccctgtgatctctgttctaagacgtcttattctaatcatattataatctgttttaatcaaagtaaacattaactataaaactttgaactgtaagaagatgtataaagtccaccaaagtagtttcatttagaaaaatttatcaagtatatctattattcaactatctcatttctaattttattataaattaatgagtttgtatcagacacccaaggaagactctctcgtcaaatctaaaaataaaaggatgaatttgaaaatttattgagttaccctttattagatgatacactttttaaaaaggagttttagcaatgaaaaaaatctgttggattttttctatcaatgttcggggtatggcaccattcggttacagcacaacaatgaatcttagacaagcaaaatcatttcaagaaaaaatcaagacactcttaccagcagaaattgagactcaatttattagttatgatatttcaagtaatgatattcctgctgcagatttacttgtttttaatgatatggattcaaactatctaagcgaagaaataaaaaaacaaggcattgctgtttcttttaaagatatggtttccggaaatactacagttatcagaaaaacaattctgaacgccctaaatttaggcggaatttgaacagtttttctgcttgtaacaataacgacacccctctcatacttatgaatatgagaagaggtgtcgttatgtattatttatctttcgtcctatctaaaataaagcaagtaataattgatctaagcgcctagataggtctctactaataagaacactgattatttgatatcttatcaatattcataacggggagaatgaagagcataaaactagatagctttttctttattcgttagttatcgttctatctgcttttaatccaaacgtaacactttcaaaaaattacatttattgtttttcgaactatattgtatgcatttcttcaatatcaagtaatgacgtacgattatgttgttctatttctgatgctcccccctataacagatgttactgcacttaaatctagtatagcaactgaaggtttaacaccaatcctaaattttttccataactcttctttgattgtatggtaagcctaccatgatgctccacaatcaaaaaaatagtatctttttgcactatatatgtatcaaatcactatgttatagtttacttaaggagggagaaaatgaaaaagatagtactaaaaaataaaaaactgcttgttacgcatgtgattatttgcgcaatcgctgcgcttattcaggttggcgttgcacttgtttatagccttatcacagaagttgctatgtcaggaaatatacaaaagcttatggttgttggcttattcgccttcttttatatcttattaaacaccatgagcgactttgtccccagacgcagtaaatctatcttggtccactcaataacggatcagctgagagtcggcctctcgcaaaagatagtccgaatggatccagaaaagtttttaaaaagcgaaaaaaattattacctttcaaagctagccaatgaaataaaagttattgagcaagaatttttgaaacctggatttggattggttttaagcatctttacctttattttttcacttcttttctctttaagacttagtgcttccttttcaattgtcatgctattgctagcctttagccccttgttagctccttattttgccaaaaaaattcttggaactcgtcgtaaagcggcggtcgaggcacaagatcatacactcagtttatttgaacaacttctttctggctatctgacactaagagtaggcagaggattcccgaaatatgctacacgtttttctgaaagtagcgagcgactgaaaaagcaaaatattcattttgaatcgttacaaggacttacctacgcgatttcttttggtcttggcgaccttgcctactctggaacgtggattattggtggtttttttgttgcagcaaaaataataacccttcctaacctcattgctatgactaccttaatgagtacgattgccggtccattggaatatttcagcacctcgattaccgatattttatccagtaagaaagtcgctgatgatcttatatcttttatcgatagtacagatgatgatgaaatgactcgatcaatcattcttgaaagtcccatcacaactttgtcgattgctaacttaagctatagttatggtacccgtacattaatcaatgaattaagctatcaatttgaaagagggaaaaagtatgcaattacaggtgcgagtggcagcggtaaatccacgctattgaatattttagcaggcatttattctgtcggtgaccgtcaactatttatcaatgaacaagagatgaatcaaatttctagagattccttgtatcaaaaagtctcacttgtccaacaaaagaccgctatttttcagaccagtattgcttctaatctctctgtttttaatgattttgaacttgaaagagttgttgatgcattaaataagagtggcttggccaatcgctttaactacgagaaattattagaagaccaagaaaacaaatggataaattttctttcaggaggggaattaaggagaatcgaaatcgctcgcgctgtctttaaaaattccgatatcattctattggatgaaccgacttctgggcttgatagtggaaatgagctgattatcaaagatttgatcaactctttcaatgataagataattatcgtagttactcattcaactagtcctgattttctagactcttttgacgagctgattcacttagatgctttacccctcaaaaaacaaaacaatccctttattcgcttgtctttatgatttcctccttgaacttgttagaaaaagaactgaacctagtaaaatgttctttgtcatactactaatgacaaagaacgtttgagggttattgtttgaggctcattgacttcctactaaaataaaatttcatcagattaaaaaattcttcttactctatgttaacaaaatattctgctattaaattagttatagagcgcgacactttacaatcaccgttactctaagcctttctttagttctcgcattcgctgcatccatcctacgtcttctacagtaactattacttaataacaaaagaacgatacttggaataggctatttgatcgataatagtaaaaattttctttatctctaaatctgcgccgattgccgttacttgatagaactgactgtaactgttccctaatgcgggaaggtaggcattagagatcaataaatcaaatggttcatcacttgtatagggtaggagaacaacgtcttgtttccctttcaactcattttctaataagtaaatagaggcatctgccaaaatactagagcccatatttaagaccgctattctcacttgatactcctctttaggagacagcatgtaaattaagaacactaatctttttttcaaatactttaatttcgtgtggttgaacaatttagtcggttcaataatattttctattatgtctaagacaaactgatttctaaacgaattgttaaacaagttatggtaataattcaaagtgactttatcgatcgaataattgaccccatgaaaataataaacttgggcgatgagagaaaagacactggatttaatggttgaatttgactttagtttataaatcgactggatcgcggccattatttcatcggttatctcaaagacgggatttttgctagtatataatcctagtcgaatttcctcataggggatcccaccaactgtaattaaaaataagcagataaaataggtgacgattgtcgcttcatctgatgaacaaatatatttttttgaaaaataactatgccgaatgtatttaaaaactggcatatctagacagcgattgatctttatttgctcatcttggcctacttcgctgtcttttgactctggcgttaaaccagtgacttcttcaacagttggcttatctgcagtgtagtgctcaatttctggactagtcaccgcatcaaaggttgtgtcatcgtctttggcttgccactcaccatacgttgtttcctctgtggcttcattggtggtgactgttcgggtgaaagtgactgtatccaccttgtctggggcggcttctgtaccgtcttcatacagataatggatcgtttgttgcacttctttggtctcggttgattccaccatgtttgccttgtaagtaaccgttacttcgctgtctttcgattctgctgtcaagtcaaccatttctgccacaccttttttatctggcgtgtagttggctatttctggactgaccaccgcatcaaaagtggtgtcattgtctttggcttcccaatcaccataggaggtttcaccggttgcttcattaatggtgactgttcgtataaattctattgtatccacatgatccggcgcggcttctgatccgtcttcatacaaataatggattatccgtgcgattattttactttcctctctcgtttctattttagggctgtaaacatacgtgactgtttggggatttttgctaacgattcctgtctcatcaccttgcacttctttcaagatatatccagggatatctttcggagtaatcgtatatgaatcgcctatattgccaccagtcattatacttggaggaagtaattctttcccctcttcatcgatataattcactgtgattggtgccccttcaatataccttggctgccatacataggtatcagccatagtcgctccatcataattcaataccagttccttagacaggaatacctgatcaccataaggagcgtctatcgtacctgatccaacattttgccaataaccggtataatagcttgaactaaatccaatcattccacttggatttgtcaaattaactggatactcattacctggccaattgttccagccgacaaagctgaatttttcccctagtcgtatttcttttagatatcgtgcatttgctagaaattgattcattccagcccctaaggctttgattacattggtactatcaaaatttgataaatctaaactagtccctctaaagccataaaacatgctgttcattgttgtggcttgacttgtatcaagcaaatgtagattcacgatttcatccaactctgaaggcacttttccataatggccagtgctttcaaatagtccaggaacatctgctggaagaacaacaggggcagtgagaactacttttctaatagtcatgtttgatgaaacttctgctattggaatcacttgatctaccgttgtagtaagcgtgccttctcctacagttagaactccctcaatatcaagggttgctggagcagtcccccacattccactccaaaggatattgtctgcaagagcagccttcttttcttcagttgctgctgtactgtctgtcgacgcttctgaactatttttctctgcatcttcttcagattccgttttagttgctgcaaattcttctgctgtcgcttgctcttcagattctattgcttctgactctgttcctacagtttcctcgactactttttctacttcttgctgttcaggcaacaactcccccgcagtaagcattgtttcttctgctgctgtagtgctaatttgatgcagctgatgcaggaatactaaaaagtgcttgtgtaaaaatcgggctgcctaatataaatacagaggaactgacaagaatacgtgatacgatttcttgcttcttcgatcttctcattatttttccttctttctatctaagtgaatgaacacagtctcgttctatccaatgcaaaaaagctgtcaactgacaactacttcagacatattttaatactcctgttgtcctcattccttaagtatgtattatcacatggctctgagtagcgaacacgacaacatctgctctaaaaaagacaagattcgtcctgtttaaaaaaaataattaaaatcctttggaaattatgacaaaaaagaaaataatcacattcatatcagtatttcaacggattatgcgaaaagattttgaacatggaagatctctttttattcctaatcattcacttagagaaaagacaaaaaaaccgcaatacaagcgtttgagcaaatcaactgtctcaacgataaaaggacttgcccacttgcgcagcattgcatcaaaaatatcgtttagagttgttttcactgtcacttatattgcagtcataaaaatggataagcagtcatacttgcagccacgtgttttgggtctgctaagtattcgcttgttgatcttgaacatttgatttagtcaagttcacaccttagctgttgatactgccaattcgaaaaagatcgtcactagcagatacggatatctaacgttatctgtaatgattctatagtgaggtatttgtccctgtttcttgaatagactcattaatagactcattttggaacttttcgatcgcctcgactaattcaagccagcgatctccggtggggaaactattccatttaaagaaacgtacttcgcgattttgattaataaagtattgacgatcgacaggataatccatcacgacaaaatccggcttttctgatacaaaagaaagagtatatccaaaccatcgttttaatcgctctttttgcctaatttcctgaatttttccaaattttgattcatgaaaaacccgcacagttgaccgatcaattctagctacaatcgaaagaagcatactgtactgaaaaagcaggtggttatttgagacatacagcgtactaaaaatcgatgattgttctgataacgattggtacatctcttgaaccagtggaaatagtttagggaatactcttcgataatctttgtctgttgttgtttttccaaaagcatcaatcttatttttagaagcaaacatgagagaggttgaatggatgttcaatgcattgacaaaaagatacgttgtagcactatcaggaacaagaaaagcttgtttcgctgtttccgaaaaaagtttagcggcttgtaagctctcttctgaaaaatgatttgtcatcgtcaactctgtagggatctcatcaggtaaataggtggtcattactgaaaacatataatacaagaagatatactcattttctgaagtttcatttaacaaataattatctcttaagaggggcattataagctcctttttgaattgctcaaaaggaatagtgagatggcatgtttctgtcattcccggtggaatttctttcaaagcaaatcctctctttaaacgatagagacttaaagccagtaattggataaacttttcttgatcgattcctcggtaacaacttggatacatcgcgagtctttctttgaaaccagtaatacttttttgagtcaggccaaaataacgtacatctgagccatcaaaaatttgccaatacatgatatgaaaaaaatgcctaatacgatattcttctcctacaaataacggcttcctctttaaattcaacgaaatattataattttcaaggatatccatgatctccttgagttttctttgaaccgtgcgattactcacaaaatgctgttgcgctgtattctccaaggataaatatttctctctgaataatcggtccaatatttgaaaaggcatgctttcttctaacatgacagaatataacttagaaagtaaaaaatttgaggcaaatcgaagtgaaatggttcttccgtcaattatttcgatatcataaaagggataccgttctctcaaatccagtgcacggtcaataactaaaacaattcttcttttcgaaacacttaatttatttgccaagtcgcttatactttcatattcctcagcattttcaaaaaaataagcaaatacttcatagacatcttgatctaatttagttaaaagaaacttatacatgccctcacctcttaacctcttactttaaataaattatacctcttctaccttctaatatcattgattgtgcattaatccataatgtttttgatttttttgataattatttaaatttctacttaaatagccagcctatttcattttgtctcataagtgtcccttctctttctcctcctattgatctgcataatcaacttccttcaatgctgcgttacaatccagtgtcttaatcagtaacttttcaatgattgaatatgaaaaaagatatattctataggattttcatctagaacattactgtatgatacaagtgccattttttaacataaaagtgatttttactaaagaaaaattgaatgactagatgatacagtcaaactagcaaacattcaaatacaaaacaaaaatgaagtgtccagaaagctgttatttcttaggtactttattgtttgaactgaaaattaggcttttatacaaaaaacatcaaagctaatgaatacactttgatgttcataaaacagttttaggataacttattaacgaattatctgagtatcctcgtatcatcagtaagaaattctctagatacattggttaaagttctattactcatttctttgataattgactaacggacccagacatgagatgcccaaggttcgcttttattttttcttccggccagtcccaccaacggaccttttgtaaatactgaatcgtttcatcattaaatctttttctgattggtttcgcaggaacgcctcctacaatggtatatggcggtacatctttcgtgactacagctctagtacctataatgacgccgtctccaatcgttacgcctgccaggatcagtgactcatacccgatccagacatcattgccaatcacaatatcgcctttattgtcccatgcagcagccacatcggctttatcaagaccccactcttcaaaaaatagcggaaatgtatacttggaacgcttgataatgagtggtttgcagcattaaacagaaactttgatccacaagcaatggaacaaaatttgccaataatcaatttgtcatgattgattgggtattgatacagcacattattcctttcaaactcgcgtggatcatttacaaaatcattataaatcgtgtattctccaacgctaatatttgggttagtgatggcattctttagatagatcgtttgtgtatcattggttcttgggtaaattttatttcgtgaagtagtcataatattcttctccttttggtgtgttaacgtttgactatttcacatactacaatgcactttttcatttttttacctcttctcaatttatgtacgtaatgaatatatctaaataatagtacttgaaatagtaagcagctgaagaaaaaaccgctactaacatggtatttcattcaactgctacgaatacgggacacttcaaaatcaatgtgcttaccacaatttaaatcaaataaattatagccattgtatactcataaaaaaacttacaccaacagttaaaataaaacaaggatatttaaataaaaaagacaggatcctttttattcatttgtgttctccagaaactatatacgattctttttttgaacgttacaaagaactaaccactaaaaactattgggcaaattgggcaaaaaatcagtcttttcatgactataacggaacaggcaaggagacaatatatagctcgactactaatagtactatgcatgcgaataacataagattttctcgacgatcatggtttggatgaagataggcttctgattttggtctatctttaatatcatcttgtctaacttttcttctaatcaatgccacttctgaaccgaccgcccaacacaaagtgaacagaataaacagcccaaacgatagataaatttgtttaccaatagcaagatacagtagaaaaaagtcaatcagcttaatcgaaaacaaagcgactcttcgcacctttcgtccataatagatccaactataactcatgcaccctcactccttcttaaattaatcactaccttttgctttcatattttgacttaatgaaagattttctcatcgattcttagtataatttcctcaatttgtatctcaaaaaacatgattataaataaatatatactaaaaaaataaagtgtccataaaaaatgatatccagacactttattcatgttcttactataaataatacacttaatttgataggttcttttttcgtttactgattctatacgataagagaattagtagggttcctaaaatcaccaacattgattgtcccaacgtttcttctcccgtagctggcaaagtccctctagaatcattctctttttcattatttttatgaagaacactatagacatacaccacttcctgcgcttcctcgctgaaaattccagaagcattatctggtatctctactacataccagcctgggatctctttggcttcactggcatatggtaacccgacttttccacttaagacagttggctctgctaattgatttccttcactatcttggtatttcacagtcactggtgccgcatcactgcgttcgtatacatacaccacttcctgcgcttcttcactgaaaattccagaagcattatctggtatctctactacataccagcctgggatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcactgaaaattccataggcattatctggcgtctctactacataccaaccaggaatctctttggcttcactggcatatggtaacccgacttttccacttaagatagttggctctgctaattgatttccttcactatcttggtatttcacagtcactggtgccgcatcactgcgttcgtatacatacaccacttcctgcgcttcttcactgaaaattccagaggcattggctggcgtctctactacataccaaccaggaatctctttggcttcactggcatatggtaacccgacttttccattcaaaatcgttgggtcgcttaattcgttgccgtctgtatcttcatatcggaccgtaactggtgccgcatctgagcgatcatacacgtagaccacttcttgcgctgcctcactgaaaattccatatgcattatctggcgtctctactacataccaaccaggaatctctttggcttcactggcatatggtaacccgacttttccacttaagacagttggctctgctaattgatttccttcactatcttggtatctcacagtcactggagcagcttcactgcgttcgtatacatacaccacttcctgcgcttcttcactgaaaattccagaggcattggctggcgtctctactacataccaaccaggaatctctttggcttcactggcatatggtaacccgactttgccattcaaaatcgttgggtcgcttaattcgttgccgtctgtatcttcatatcggaccgtaactggtgccgcatctgagcgatcatacacgtagaccacttcttgcgctgcctcaccgaaaattccataggcattatctggcgtctccactacataccaacctgggatttctttggcttcactgatataaggtagtccgacttttccgcttagaatcgttggctctgttaattgattcccttcactatcttggtatttcacagtcactggtgccgcatcactgcgttcgtatacatacaccacttcctgcgcttcctcattgaaaattccagaagcattatctggcgtctctactacataccaacctgggatttctttggcttcactggcatatggtagtccgactttgccattcaaaatcgttgggtcgcttaattcgttgccgtctgtatcttcatatcggaccgtaactggtgccgcatctgagcgatcatacacgtagaccacttcctgcgcttcttcaccaaagagtccggaagcattatctggtgtctctactacataccaaccagggatttctttggcttcactggcatatggtagtccgactttcccacttagaatcgttgggtcgcttaattcgttaccgtctgtatctttatatctgactgtgactggtgccgcatcgctgcgatcgtatatatacaccacttcttgcgcttcctcgctgaaaattccagaggcattatctggcgtctctactacataccaacctgggatttctttggcttcactggcatatggtagtccgactttgccattcaaaatcgttgggtcgcttaattcgttgccgtctgtatcttcatatcggaccgtaactggtgccgcatctgagcgatcatacacgtagaccacttcctgcgcttcttcaccaaagagtccggaagcattatctggcgtctctactacataccaacctgagatttctttggcttcactggtatatggcaatccgactttgccattcaaaatcgttgggtcgcttaactcattgccgtctgtatctttatatctgactgtgactggtgccgcatctgaacgctcataaacatagaccacttcttgtgcttcttcagtaaatacaccgactgcattatctggtattttgaccacgttccagcccgcgatctctttcggattgctttcataaaccataccgacttttccacttaaaaccgttggttcactcagctgttcgccttcagaattctgatacttgactgttacaggagctgcatctattaaattgggctgccaaacatacgtatcggagtcagtttctccattgtagtttgccattaactcggaagccgaccaaatatttagcccattcgggaaatctattgatcctgttccaacattgacccattttcctgtataaatttctgatgaaattggactaggcaacattgcatttgtataaaatgaaaatgactgtcctaatctgatgatcttcaacgattgcataccgctaaacatagaagacatattcgttaccttactggtatcgaaacttgatatatccagactagagactctatttaagccctgaaacattcgatccatattcgttacttggctagtatcaaaattgcttagatccatactgaatgtatcgagatcacttcttcttaggtttgcgaacatcaaagacatgtccgtaacatttctcgtatcaaaattgcttaaatcaaatttatcgatattaatcacattcgcgaacatcaaagacatattcgttacatttcttgtatcaaaattggagacgtccaaactagtcaaatcgaacagtccattgaacatcgcatacatattagtaacgttacttgtatcaaagttggatacatcgagctttgttaaccctcgagtattattaaacatgccagacatattcgttactcggctagtatccagcttgtccaagccttctatttcagtaaggtcagcccacgtaccgccggagttaccaaataaataagaagaatcctcaccagcaataacattcccctcgaacacaatttttttaaccctataccgggaccaagggttaatctcagaagtagatcggaatgttccagatccgatatggagaactccgtcataagtgatataccaatctgaagtaccataagttcccgaggccatattttcagtaggatcttcagtagtttgattctctattacatctgtttcattttgacttctaacttcattctcacttgaagaagaagtcgattcgttcagttcgacaggttctgaactatctgattgactaagttcactgggctctgtattccttccatcattatctttcgttgaatgaatgtgttcatccttactatcacgagacattaaagtttcttcttgttccacagcgatcgtgctctctactgtatcctgtatagaaacagtatcttcagtcactgaatcagcgctaacaaccattgtccatggcgcttgatttaacaacaagcctcccaacaatagtatcctgctacactttcccataccaagtcatcctttctcttttagtctttctctttagtatccatattccgattatcatcaatggatgttattacctacatgttttgtattgtctctgtgctaaaggtgttttgttaatcaaaccatgcgctttacctgctgattcgctttcaagctttcaataaggttcgatctaaagaattttctttaaaaagttgttcccaaccctcaacttcgacaaatggattttctgaggctttctgtatgcatgtaccttcttctagtgccaaaaatcttcgttttttagataatagtttctcatttagacattttttcgacaaaaatctataattcaagttttgtaagacattcgaagttttcggatgtctattttcgtattgtcccaaaaacgaaggtttttgagacagatagattattttacattctctgaatatattactattcatcgcagctttctcttaatcaactatttctccagacagtgaaatagttgatttgctttttactccaaccttatctacagttccaaatcaaatcgcttcgcctatccttgctttttttgttaagataaagaaataatgagtaagaatttaggtgatgatttatgcgactgttgtttttctttttccttttcacatttttgattggatttctcttctatttattgacccgtcgcacgatcgccgaagtctatcatgaattgaccgataagaaccgcttctttcgaggcatcaaagctttcttcattggaatttatcgcattttgacttctgtttaaaaaaaactgtccaacaacagatctcttgatcgttgctggacagttttttgtttgattcgtcttctatttcaatggtttccattgccaatcttggacttcagcaatgtcatagccattctcacggataaagtcatggtgataggcaaccgtctctgtcattcgttgcgcaaagtcggcagcttgttcgccatagacccactcagcgccgtctttcgctaaatggaagcgatcaagttcagataagatccgcatgtcaaatggtgtggtgatatcgccattttcacgatagccatgaatatgcagacgctgattcttgcggccgaagaaaatgtcccgaatcagtccttcatagccatggaaagcaaaaatgattggcttgtccttagtaaagtaagcctcaaattcttcatctgtcaatccacgaggatcgacatccggatgacgtattttcaataaatcaacaacattgataaagcggattttcaactctggaaacgcctcattcagcaggcttacagcagcgagagcttctaaatttggctctgtccctgctgcagcgatcaccaaatcaggttctccttggtctgttgaagcccaatcaatgatctttaagccgtcttttaccaatatctccgcttcttctgccgtataaaactgcggccgaggatgtttcgaagaaacaatcagattgatctgttcttcagtttggaatgtttctgccattacagccatcaagctattggcatctgctggtagatagacccgtacgaattccgcttttttctcagcgatatgtgtcatgatccctgggtcttgatgggtatatccattatggtcttgctggaatacggttgaggaagcaatcaaattcaatgacggataggcatggcgccaaggcaattctttcgatttacgcgtccacttaaagtgctgagtgatcatggaatcaaccactcgcaagaaagattcatagctagcaaaaaagccatgacgcccagttaagacgtagccttctaggaagccttctgcttgatgctccgataattgggaatcaatcacccgtccggtagcacttagccattcatcatagtttggctgttttggttctaaccattggcgatttgtcacttcaaaaacatggttcaaacgattggatttggcttcatccggaccaaagattctaaaattagtcgggttttcaacaatcaaatcccgagcaaactttccgaactccatcatgtcttgagcagtggttgagccaggaacaccaatatcgatcgcatgctgtcgccaatcggtgattttcaacggttgaggatcgattcccccgttagtgatgggattcattgccatccgttgctgtcctttcggcgcgagttcttgaatctcagccttgatgcggccagattcatcaaagagttcttctggcttatacgatttcagccaatcgattagtgcatccacgtgctccatctgatgcgcattgactgggataggtacttggtgggcgcgaaaaccgccttcaatcggctctccctcccaaatttttggtcctgtccatcctttaggtgtgcgcacgatcagaacaggccagtggggcatgactgcttcatcagcttttccttgacgagctttggtttgaatcgctttgatctgctcaacggcgcggtccaatgctctcgccatttgcggatgaacagtagcaggatcatctccctcaacaaaataaggtgtccaacccattccttcaaaatacttggttaggtcttcatcagatttgcgagccagaatcgttggattagagattttagcaccgttcagatgtaagatcggcagaacagccccatcatttaccggattgataaatgtattagaaaaccagctgcccgctaacggaccggtttcagcttcgccatctccaaccacaacagcagcgatcacatcaggattatcaaggacagctcctgttccatgcgcgatggaataacctagttcgcccccttcatggatcgatcctggtgtttctggtgccgcatgggaagcaattcctcctgggaaggaaaaaattttgaaaagatgctgcatcccggcctcatcttgggttacttctggatagatttccgtataacttccatctagataggcattcgaaaccatcacctgacctccatgaccaggtccttcaatgtagaacatattcaaatcatatttattgatgacacgattcaagtgggtgtagataaaattctgaccagcaatggtgccccagtgaccaatcggattgactttcagatctttttcttcaatgggccgccgtaacagtggattgtctttcaaatagatttgtccgacagaaagatagttggctgcccgccaccaagcattcattttgtcaaaatactcttgggtatcaaatgttgtctccatactactcctccttgctttctcttaattaaaagtctatgcgtctcgattttaaaagtcaattttgctgattgtacaccttgcatctctcttatgatttgtctgcttcagcacaagaaaaaacaagaccagagttcctcccaacatgtttcagtatgagagggtttggtcttgtcagtgttggctcttttctgttgtcttgtctacttttttaatagctacttgatcgtcacatagtccaaaccaacgagttttgcccacgtctcgatttgatctgacgtcaacgctaatgaaacaaccgtatgatgtccgcctcccgtttcgatccattgtttgactccttgatgaaagtcgggacgaggcgtccacatcacgcgagccaccggcaatttaggtgcggcttctgttggctcaaaagcatcgacttcattgatcaataatttatagtgagtgccaaagtcggccatagatacaactactcctgcgccaccttgtccgtcaaagactaatcgtgctgggtcttctcgatcccccattgatagcggcgaaacgacgatttttggtttattgacagccaatactggatccacttccatcatatgcgactgcaagatggcttctttgccttcggtcaactcataggtatagtcttccataaaaccggttgctttattatgtgccatgatcttcataagacgatcgatggctgctgttttccagtcaccttcaccagcaaatccgtatccttccgccatgagtcgctgtacagctaatcctggtagctgttgcatgccataaagatcttcaaagttggtcgtaaacgcactatagcctcctgcttctaagaaacggcggatgccgatttcttgtttggcctgtactttcacatgtgcttcccagattgcggcttcataatctccctgatcaaactcatacaaattacggtattcttcaaacaagtcattgatctcttcatcggtcacagcatcgattacttgaacaagatcaccaatgccaaagtaatccacggtccaaccaaattggatttgtgcttcgactttgtccccttctgttaccccaacattgcgcatgttgtcgccgaaacgagcgactttgatagcaaaactttcattgtaagcaaccgccacatccatccaagctgcgatttctttttggaccgtctcttttttccaataaccgacaacgattttgttttgtttctgcaaacgcgcattgataaaaccatattcgcgatccccatgggctgcctgattcaaattcataaagtccatatcgatggtctcccaaggaatgcgttcattgtattgagtcgccaaatgaagcaatggtttttgcagcagtttcgttccccggatccacatttttgctggtgagaaggtatgcatccaagtaatgacaccagctacttcatcccgataattgacttccttcatgatctttgtaatcgtgtccgcagtgactgccaattcttgtaaaacgactggataaggcagatttccactgtcattcaagcgtttgaccatttcagctgcatgatcgcggacttcttgcaaggcttcttccccatataagtgctgagatcctacaacgaaccaaaattcttttttactgattgctaacatattgtctgctccttcttgattatttttgcccatagtaggcatctttgccatgttttcgtagataatgcttgtcaaggatgcgctgcggcagttccggtgcataactattgatctgacgcgtcacaacgttcatctttgctacttcttctaaaacgactgcgttcatgactgcactttgagcatctttgccccaagtgaatggaccatgtccctgcagcaagacgccgggaatctctaaaggttggataccgcgttcctggaaagtttcaacaatcacgtttccagtctctgcttcataaccacggtcaatttcttcctgtgtcaaaaagcgcgcacaagggacactgccataaaaggtgtcagcgtgggtcgtgcccattgccggcaaatcaactcctgcctgtgcccaacttgttgcccaagtggagtgggtatggacgatgccgccaatttctggaaacgctcgatacaatacagcgtgagtaggggtatcagaagaaggattcatctttccttcaacaacgttcccctcaaaatcgcagaccaccatatcactagcttgcatcgtttcataatcaaccccactaggtttgatcacaaatagctgctggctgcggtcaacggcagacacattgccccaagtgtatttgatcaagccctgttttggcagagctaaattggcttggaagacggcttctttcaattgttctaacaaatgactcacctctatttttgttttaaatcaatccatcgatcgctgcttgctcgatcggcagaccgtgttggtagcgcttaacaaactcagtaaaaccaactatatcctcaggtaatggcgctaaagttgtcccttcttttccttggaaaactctggataaaaagactgtaagtgtttcttctaccgatttttttttcataaatgctgccagtaaagcgatgccccaagcaccaccttctcctgctgtttccatcaccgtcactggtgcttccatcgcagcagccaacacccgctgcgcaacagtcggagtcttgaaaatccctccgtgtcctacgattcggtcgatcttgacttgttctttagttaggatatccatcccgatcttcatcgcaccaaacgcactaaacaaatggagccgcataaagtttgctaaagtaaagcggctttctggggagcgaacaaacaatggtctaccagctgctatttttgtaatattctctcctgagtaatacccataagacaacaacccaccacagtcaggatctcctttcagtgcttggttgaacaatgtcgtaaacagagcttctgtgctcatttcgacccctgctgcttctacaaattcccgaaaaactttgacccatgcattgatctccgaagtacaattattcgtatgaaccatgccaactaaatctcctgctggcgttgttaccagatcaatttctggatagactttagagagaccgctttcaagaacgatcatagcaaaagctgatgttccggcagagacatttccactcctttgcgcaacactattcgtcgcaaccattccggttcccgcatctccttcgggtggacagaatggaatacccggcaacaatgttcctgttggatctaaccgcaaagcacctgctgccgacaaagtgcctgctgcttcaccagccactaagactttgggcaaaatatctgctaactgccaaggtaaattttctggaaggatcagatcatcaaactgggccatcatctgtcgatcatagtctttttgtaggctgtcgattgggaacattcccgaggcatccccaataccgattactttttcacctgtcagctgccaatgaacatagcccgctaatgtcgtcaaaaagttgacttccggtatatgcgcttcttgattcaaaatggcttggtacagatgagcgatactccagcgttgcggaatattgtattggaacaattcagttagagccttttcggctgcttctgtgctggcattgcgccaagtgcggaaaggcaccaataactgatcattctcatcaaaagcgagatacccatgcatcatagcggaaaaaccaattgaaccaattctcgtcaaaggttccccgtatcgggattgaacagaagctgctaatgcttgatagctttcttggattccttgccagacagatgccaaagaataggtccagacaccatctaataactgactctcccactcataactaccggttgcgatggtttgaaattgctcatcgatcaagacagctttaattcttgtggatcctaactcgattccaagtgccgtgcgcccttcttgaatcgcttcacttatttgctgctccatttctcttctctccttttgaattttgatatacatgaaatcacgaatggctcatgacggagccgcgaacaatcaattctggctcataataaaacgtttcttccaacgtagttcctgaggtgacccattgtgccgctaaaatccccatctcttcctttgggtgagccagtgtggttattcctggtgaagtcaatgtacttaaaggtgaatcatcatttcctacaattgaataatcttctggtacacgctttccattggcttctaattgctggatcaacccatgtgcaatttcatcgttataacagacgattccagtgatctcattcgattggttcaaccggtcaatcgcttgtgcaatgacagcctctttggtttctgtggtataagtcacgacatcttcagcagcaaatgttttctttgcttgttccaaagctttgacaaaacctttcatccgatatttcccttgtaaatcatcaattttagtgatcagcatcaagtgttgatgctgctgttccaataaataattcgtggctagatagcctgaacgagtgtcattgacacaaatatgaggcagatccagttcttcatagtaggcattgatcatcactagcggaatccctgcttctttcaatgccatgtagtaggccaaattgggattgtattgactgctcttcgtcggttcaacgattaagccatctactccttggtccatcatttgttgaaggcaagctcgttcttgttcatggtcattatttgttgatcccaacagcaaagaatagccttgttcccgcaatgtctgctcgactccgcgcataattgaagggaagatataatccgacagatacgtcatgatgatgccaatcgttttatggctgcgttgcggaagattctcaggttttgaaacgtacgtaccagatcctctttccttacgtaaatagccttcgtttactagcaaagcaatcgcttgtcgcacggtatgtcggctcaaatgatattcttcttgtaatacagcctccgaaggaatcgtcattccttctttataggttcctaaacggatgttttcccgtaattcattcgcaagttgttcgtacttcgttgtcatattaatcccatctttcgaaagttgtccgtacatatagtatatttggaatgcgctttcttgtcaatgtaattttgtaaaaatcaattttttacctgaagcagaaatataatagtcagtggcagcctctgctaaatgcacgattcgatcaattgcaactgttcagaaaagatgaattgctatacaataaatgacaacgacagcaaaggaggttcttcctattttctcttttaaagatattaaagaaaattacccaaacgctgctttgcatccagcaaaatcaacagatccaggaatcgaatcgattccatttggtcagaaattcatctggctgcctactgccgatctatcggcaaaagaaagaatcatgctgcaattaggcagcggtgcactgtttccggtaatcgacaaccgttttcgaccatggtacccgattttatttgaacatcagccgataaatgagaccggtgattatcgcttgttgcaagtgaaatttacgagtgggatcgatttattgcagactgagtggctgcaagagatccagcaaatgctcccccatgtcgtcgacctcttttttgttaccgaagacagtgcgttgattgttgaacagcgggctggtgagaacttgcgcttagatgaactggatggtttatttgttgctttagatatggattttgactgctactcgcatttatttgtagggccgtttcaccattcgagccatgatttcacacttctgctgactgaagaaatgactctttttcaacaattgactcgacaaaccaatttaaaaagtttggatctggctacatctctgatccatttgctaagcactgccggttccgactatcaactattatttcgaacactttatcaggattggtttcaggaaagcgatcttatccatttgatcgagtcgctgtggaaaaatcaaggaaatgccagttctacagccaagtcactcttcatgcatcgcaatacactactttataagatcgataaattccaaagtatgactaatctgaacttaaaagaaatggatgatctgctgctgtgctattttcttatcaaaaatttcgctcatccagccgattgaacaacttgcacaagaaaacgttttttttcttgtgcatatttccgttgctgaatcaaagcgttttcatttatgatacaggtgtaaactaaatggaaagaggtaatcctaatggtagaaatggctctgaaacacgtgcataaaaaatacgacaacaatgataattattctgtaacagattttaatttagatatttctgatcgcgagtttattgtttttgttggaccttccggttgcggaaagtcaacaacgctgcggatgatcgctggattagaagatatttctgaaggagaattatccatcggcggcaaagtaatgaacgatgtcgcaccaaaagatcgtgatattgccatggtattccagaactatgcgttgtatccacatatgacagttttcaacaacatggctttcggattgaaattacgtaaatacgataaagaagaaatcaaaaaacgggtagaaaatgctgccgagatcttaggattgacagaatatctagaccgtaaaccagccgcactatctggtggacaacgtcaacgggtagctttgggtcgtgccatcgtacgtgatgccaaagtcttcttgatggatgaacctttgtcaaacttagatgcgaaattgcgggtagcaatgcgtgcggagattgcgaaactgcatcaacgtcttgaaacaactacgatttatgtaacccatgaccaaacagaagcgatgacaatggcagaccgaatcgttattatgaaagacggatttattcaacaaatcggttcaccgaaagaagtgtacaactcacctaaaaatatgtttgttgccggctttatcggttcacctgctatgaacttctttacagttactttgaaaaacggcatgatctcagacggccatggattaaacttacgtattcctgaaggcaaaaacaaagtccttatcgaaaaagggtacgaaggcaaggaattagtctttggtatccgtccagaagatatccacagcgaacaaatcgcattggaagcttcaccagaagcaactgtccgtgcagaagtagtcgtttctgaactgcttggtgctgaaacaatgctttatacaaagattggttccactgagtttatctctaaagtagatgctcgtgacttccatcgtccaggtgaagtgattgatcttgctttcaacatcaacaaagcccacttctttgataagacatctgagaatgtgatcacgttaccttaatttgtagttttcttgcactgtccttggtttgccccctagacagttgcaattaactaatatccacttttattccttatttgtatcccctgaaaacagacagccctgcggctgtctgtttttgggtggattctctttaggtgaagggactactttgaagctctcttctcaagaaagcgtacataaaattttttgatcgttgggtattgacgatatgccaagaaaacaactttgattcttttagtagtaactgggtcgacatcaatgattttcttatacccgacagttccgcattctgctaaaaatcaatccttgccatctttttcataataaagtactgctttttcaattctctgactctcgcggatttcttcttgtaaaatcactgtattgatttgtgttggttgtgcaaaagtcactgttacccacggctcatgatcgttatccgcaggttgccaatacgtcttctttgatgaggtaaccttctgcaggctttcttgatcccagggtgatttttgggaagaagctgtgatctgtccttggtacaacggctgatccgtttgtaatggccgtagatattgccctaattgcatcagtgactgctgatctttcgggtggatcgccccattgggcattggcggaacatttaataaaaataccgcgtttcctcctaccgctttccgatacaaagaaaataatgtttcggcacttttcactgctgtatcctcttccggatgataaaaccagccgggtctgattgatagattgacctctgcgggataccagactaaatctctgctggaatcgtagtttctcaatacagatcggctacctaaatcttctgccatacttgagattgtcgtccggaattctgctgtgtctgtttgttgtgatttttcggccgtcttttcggcatccaatagctcacggggaacgacactccactcattctgccttgtgtgcccggcttcatttccgatccagcgaacatctggaccgcaaacggcaatcacagcatccggctgtaattgccgaatctgttgataatatctttgccagtcataaaactgccgctttccgttaggtccttctccattggctccatcaagccacacttctgctatttcaccatactgcgtcaataattctgtcaattgacccacatacacctcgttataggcctgtccggtgccgtagcctgcggcgtgctgatcccacggagaaagatagatgccaaacgccatccctgcttcttgacaagcctccgacaattctttgactaaatctcctttgccatttttccaaggtgtataagcgactgtctgctgcgaatagttgctgggccataaacagaagccatcatggtgcttacaggttaagatcatccctttcatcccgctgcatttgcaaagcgtgacccactctttacagtccactgcttgcgggtcaaatagtgctaaggattctctcccatttccccattcccgattcgtcatggtattcaagccaaaatgaataaagccataaaattcccgtgcttgccatagtagttgacggtaactcggacggatcgccgtcaattcttcaactttcatcgcacttcccctttctccaactgattgtcagcaaactggaacccattcagataagtgttcttactggcgatggctcactaaccgcagttgttttgtttttggtctttacagcaaatagagtagtagatgccaaatgaattgacaagccactactctaaattacatagtttagtttgtttcacatagtttttttccacaggttgcgttcaggattgcaacaccagaatagccgagaactaattcaactgcaataatgttaaactatctgctaagaccgcttcaccatcaagaagctcgtaatcttctggtgtgattagtttatacggaactgctttatagttcaaaaaatcttttaagcgattgatttcatatttcgattgtggtccaatcagtaatgcatcaacagtctgattttgaatgatttgttcagcaatgattgctggtgctgaataaatatggacagttattccttgttcatccgctgctcgctgcatgtttttcactaatagacctgttgtgatgcctgctgtacagatcaataagatcgtcttttgtgcttctgtccccatatttacagcctcctaagatattttctttttcttattataaatatctaagacaactgctaacagcaagatcaatcctttgattgcctgttgccagtcgacccctacacctagaatcgacatcccattattcagtactcccatcactaatccgccgacgatcgcacccatgatcgttccgattccgccagaagttgaggcaccgccaaaataaacggcagccatggcatccagttccatagaggttcctgcttgtggtgtcgcagcgttcaatcgtgcagccaaaaccaaacctgccaatgccgccatcgcgcccatattgacaaagacccagaaagtgatttttttcgttttgattcctgacagttcagcggctttcctatttccaccagttgcatagatttgacgaccggcaactgttttatttgttaagaatccatatgctgcgacgatgactcctaataaaatcaagatgatcgggtaaccctgataagaagcgaacacataagttgcgccaatgaaaacgacaccgatgaaaagagctttgaacaaaaaggtactggtggactctacttcaaacaaatttttcttgcggcgttcccgggttcgccattgaccaaaaatcaatagtgccgtgataccgacaccgataatcattgaaaggagatgaatatgatcgctgctgacaatatcaggtaaatagcctgttgaaattttttgaaacgaggtaggaaatggtgctaaagattgtcctcccagaacgacttgagtcaatccacggaacatcaacagtccagacaacgtaacaataaaagcaggaatccccacataagctacccagaaaccttgccaagcgccaatcaacgcaccaatcagtacacataatggcacagccacccagggactcatgccattattgaccatcaagacgccggcgattgcgccaacaaacgccatgacagatccgacagacaaatcgacatgccctaacaagacaactagtaacatccccgcagctaaaaccaatatatgactattttgcaaaacaagattggtgatgttcaatggtcgccagaaaataccatctgtcattgcttgaaaggcaatcaataagacgaccaggataataatcatgctgtatttgctaaaaatctctaacgctttgtctttgatagaatgtttttgcactttttttaatttattcgttgtttccatcctaaaccccactctcttctaatgtcatcaagttcatcagcagttcttgatccgcatcttgccgcaatacttctcctgtaaaacgcccttcattcatcgtatagatccggtcacacatacccaaaagttccggcagctcggaggaaatgatacagattgctttacccgcagatgccatttcttcaatgatcgtataaatttcatattttgctccaacatcgattcctcgtgttggctcatctaaaaataaaatatccggttccgtcatcaaccacttagccaaaacaactttttgctggtttccgccgctaaggctgccaacattttgatagattgaattggttttcgtccgcatttttttgcggtattcttctgccaaaattacttctttctctttgtccaaaacaccgttgcgactgattttattcagactagcaatcgttgtgttctcccgaatgtccatcaatagattaagtcctaatgctttacggtcctctgagacatacgcaagcccatttctaacggcagctggaacatcttttacggagatttgttgcccttctttatagacttcgcccgtgatattgctgccataggaatgcccaaagacactcatcgcaaattctgttcgtcccgcgcccataagcccagcaatgccgatgatttctcctttgcggatcatcaaattgagatcttcgttcacgattcgatttgtatcgataggatgatgaacggtccaattcttcacttcaaaaaaaggatcaccaatctggggatgccgttccggatagcgattcgtcaagtcacgaccaaccatcccgcgaatgattcgctcttcagaaatctgattgccagccatcgtttcaatggtttgtccatcgcgcaaaatcgtgatgcgatcggcgacattgactatttcattcaacttatgagaaataatgatggaagtaatcccttgattacgaaattctttgatcaattctagtaaattggcactttcttcttcattcagagcggctgttggttcatctaaaatcaataatcggactgatttagaaaatgctttggcgatctctactagctgctgctgccctacaccgatttgtgaaaccaatgtattaggatcaagacgcaagccaactgtttttaataaattatcggtcttcttttctgtgatattccaatcgatgatgccatttttggcttgttcatttcctaaaaaaatattctctttgatggataaataaggacttaaagccagctcttgatgaatgattacgatccctttttcttcgctatctcgtaaatctttaaatttacagagctctccttcgtaatatatttcaccttcatacgtgccatgtggatacaaaccgcttagcacattcatcaatgtagattttcctgcgccgttttcaccacatagcgcatggatctcaccacgttcgatcgaaagatttacattgcttaatgctcgtacgcctgaaaattctttgacgatattcttcatttcgagaatataatctgccatgtcctttcacccttttctttttatgtagtcagagattctgcagaagaaataaaatgatccattcaaaagaacggctctttgacaaacaagaaagaacagggcaaaacattggagtatccgctgatctgccccgatcattatcccttcagctgctcttttaccttttttgcgcttttgacagccccactgtcaacaactagcccagatctttttccgtgtaatagtcactgtccacaagctcttctttataattgctgctatctacagagactggattagatagataggtcggtaccactttgaccccattgtcataagtttcggtatcattgactgggacttcttcgccattggcgattgcttcgatcatttcgatcgtgtttttggctagaactcgggtatctttgaaaatcgtttgcgtttgttctccagcaatgatcgatttaactccagcaatggttgcatcttgtcctgtaattacaggtaatggtttttcagaagaaccataccccacaccttttagggatgagatgattcctaaactgattggatcataaggagaaagaacggcatctaatgttttatcggtatagttggcactcaataagttgtccatccgtgcctgtgcagtagaaccatcccagcgcagtgttgcgatttggttgaaattcgtctgacccgaaggaaccactaattgaccactatcaatatactgttgaaaaacagacatcacgccattgtaattgatcaacgcattgttatcatccggtgaaccaccaaacaattcgatattgaagggtccttttccatctttcaggcctagcttgtcttcaatataagaagcttgtaaaacacccacaccgaaattgtcaaaggttgcatagtaatcgacgtactccgaattcatcaataaccgatcataagcaatcactttgatgtcctcgttatgagccttttcgagaacatcggtaagcgcggaaccatcaatagaagcaatcactaatgtatcgacgcctttagtgatcatgttttcaatttgagcgacctgattctcaaccttatcttcgccatattgcaagtctgttttgtagcctaacttttccagttcatctaccatattgtttccatcggcaatccaacgttctgctgattttgtaggcatagcgattcccacaaaccctttgtccccgctgctggctccaccactatctgagccgtttccgcaagctgccaacatccctcccaagagaacggttgaagcgatacctacgatttttttcattgtgcttttcatttattgatccctccatacttttacttacaggctaagtatagaaaaaacagcaatcgcttacattaactatttttggtagtttctttgatttcttgggacattggaattcaaaccttgattttctttcgattaccttgttttttttcggaatcttgaaattaagaaaagcgcttacctttttttggtaaaatagaggtcgggggtgaaattatggataaaaaaaggttacacatcttcctttcgatcctgcttatgaccagtcttagcgcctgccaacgaccatctgaggggaccaatgaatctgctaaagagagcattgtcattggcttttcgcaatctggtacagaaagcagttggcgtaaacgtcatactgaatcgattcggacagagttagagaaagaagggtatgaagtactttatcgaaatggctatatgaatcaagaaagacagatccaagatatccgcagttttatcgtttaccaagtagatgcaatcgtctttactccattacaagaagatggttgggaaccaatactcgaagaggcggccaatgcaggtatccctgtttttatcgttgatcgtcatgtggatctggcagatccttccttatttttgacacatatcggtcctagtttcaaagcggaaggcaatcgagctggcctttatgtcagcaattatttcaagcatcatgaaaatgaaacgatcaacgtgctggagttgaccggactcagtgatacatcccctacgcaactacgttcagatggctttcgagaaaccatcaaacgagattatgcgaaaaacaatgtcactattcaagtaactgatgccttgaatggcgacttcattcgtagaaaaggcaaagaagtgattgaacaatatattgcagaaggaaaaatggccgacatcgatgttttattcagtcataacgatgaaatgactatcggcgcgttagaagccttgaaacaaacagatatcgtccctggaaaagacattgttatcgttacgattgatgctcaaaaagaaatgatcgacaatttgaaaaacggcatcgttaattgcgttgttgaatgtaatcccgatgctggtatcttcgttaaaaatgctatttcccgttatttaagtcggggcagaagtgcagttccaaaagaaatctatgtccacgagacagttttttcaagtgatatggattttgaccagattccaccccgaaattattaaggagtcattcatgaaaaagacaagtataaagggcatcttccaacaaaccaataaattgatgatcttagtcgcttttcttcctttattgatcagtagtatcttttattcccgccaaatttttatttatcaaaatacgatcaacaatattgaagaagccaatcagctctcgggtaaagtggatgcaattgttttagaagaaatgtgggatcttgtctttggccaaaagagcgtggcggatgttcaagtcaataacgtcattgaagaattgcgcgcggatcttgaccatatccaaacaaatacgaatacagccaaagaaaagaacacgttggctgttgccttacgtacactggattcattagaaacctaccaaaacaagctcatcgaaaatattgctaacgatgaaccactagaaaaaaatcaatatgtgatggtccaggtggattctgtaattgaattattatctgaaatcctgcaggaatttgttcgtgtagagattagtttggcaagtcaaaccaatcaagatttgattcaatctgtcttgttattgatcgcttttcaattgcttttgattcttttgattatttactttatttctaaaaatcgccgctttgttcgcgaaaatctccaaaatccattggatcgtctagtcgaattatctgatgaacttgcccaagggcatctcggctttcgagcagtcctgcctgatacaccggaattgcgcacattgacgagcagtttgaataaaatggcggatgatttaacccgtttattagaagagaatgctttgaaacaataccatttggctcaaagtgaagttcgtgtgttgcaagcacagatcacgcctcactttatttacaatagtttggatgcgatcgtctctttgatcgaagtagaacgatatgaacaagcaactgaaatgacgtacgccctctccgatttttttcggatttcactaagcaaagggcacgactggatccctctttcaaaagagttgcgccatgttgctgactatttaacgatcctaaagatccgttatggggagatgctgacctatgaaatcaaccagcagaccacttcccaagacctactagttttaaagatgatcctacagcctttagttgaaaatgccgtctatcatggcaccaagtttgtacgccgagtaggaaaaatcaccatcacgattcaggaatatgaacagacaatccagatgtctgtccgtgataacggtattggcatttcccacgaacgattaatggccatccagcataatctgaaagaaaatacagatcccgatccagaaaatgggtatggtctttataatgtttatcgtcgtctattactaaattacggtagtgacgtacaatttgatatcgcgagtattgaatcacaaggaacaacgatttcgatcatcgttcctaaaaaaggaggagcccactaatgtacaaagtcttcatagttgaagatgaacacctgatccgtgataacttgcggcatcagattatttctctagctgaaaaataccccattatttatagtaatgaagcggcagatggcgagttggcacttgcatcgattcttgacattcgtccagatatcatttttacggacatcaaaatgccttttatggatggactgacctttgccaaagaggccaaaaaattattgccacttgttcgaattatttttattagcggcttcgatgattttgattacgcaaaaacagcgctacaattgcaagctgatgactatttgttgaaaccgatcaaaaatgaggaccttgaacagacattgattaaagtcattgctgcattggaccaacagtcccaagaacaacactatctctcacaagatgatgaactcctgcgaatggaggtcagaaagaatctctttttgaatactcttttcgcaagtaaaatcacaatttcagaagctttccagcaagcgaccgagctaaagcgttccttttctggtaaacaattttgtgtcttgttggccaagacaccatacaatcagaatttttcggattatacccgcttcagtaagcagttgacttctacttatggttccgatgaaacagtcttattctccagcatttccagtcgcttcatcaaattcctgctttttgatttcaacaaagatgctgtactcgagaaagcctaccaaatggcacaagcgctcacccatgactcaagtgaggaagtggcagttgccctcggaccggtagttgagcggttttcggacattccaacttcctatcacaaagccaacgggatgttgaaaacgtatggcggcatccgcaaggaaaagatcattagctatgaggatgatatgaaagaaggagaattatctcctacgaatcctttcaaaatcgaccttgccgaacgaatctcccagactgagccagaggcgatcaatgacttagtcaatgaaatcatgtccgctcaaggaactgcagaaagaacccaaatgtatcgtttttttgttctggtagaattgattgcgctggtaaaaaagcgtgaaggcaaagaacaaaaggacttgctagctcaaactgcggatttagactatttatcccaactgacaagtgagccacacaactaccaagacaaagtgactgcactgcttacatacttagtcaagcagcaaatcaatccggcaatggcaaagtatcaaagtgtgatcagtcaggcaaaacagtttattgacaaaaatttttctgatccaaatatttcgttgaatgtcgttgcagaaaaagtcaacttgagccccgcccatttcagtacgattttctcgcaagcaaccgatgccacattcattgaatacctcacagaacagcggctttcattggcaaaaaaactactgatcacaacaaatttgcgcctttccgagatcgcctttgatattggttacaatgatccaaattacttctctttcctattcaagaaaaaagaacagatttcacccaaagagtatcgtcagatccaccattgacagaagttcaaaaaaaccagcccaaccttatacataaggctggactggttttttaggctagcaaataatgcaagaagcaaaatcgttgaacgaacaaaatcaatactggcgtcttgccttcagccgttcgtcattcttttttctccatcgccgcttttaatgctgcagccaatggactttcttgcggttcttcctgattgatcttttgcatcaaccggcgttcttcatgtttggtcaattttttgttacgctctttcttatctgccattttctcggtgatcccatcgaacttgcaacggaagaaagcaccattctttccttcaatgatctccatctttcgatgacattgtggacagcgatggttagacactttaggatctttacgacgacgatacttacaggtttgacttgaacaaacatagatcttgccatctcgggtactcttttcccttaatggttccccgcattcaggacatcgtttttgcgttaaggaaaagtcttgatatttgctttcgctttgcttgatttctttgactaattgcttggtatgtttttctatctgagcaaggaatttttgttccgagtattttcctttagcgatcagttctaattccttttcccatttctccgtcaattccggagtgactaaagatgggttgactagcaccaacaactgcttgccttttggcgaaacttgtaaaccgctaggtgttcgctccatcaactctgacttgatcaatttctcaatgatctcagctctcgttgcaggcgttcctaagctatgtttttccattttgcctaagagcgtaccttcattcaatggtttcggcggcgtcgttagttccttttgaatactgaatgttggtttgacactcatttgttcctgccaagaaacagtggttgcttcttcttttgactttttccagcctgcctcgatcacagtgttatgggtaaagacaaacacttcattaccaaatttgactgtaactttttgctgctgcttcttatgcggtttggcaaaaagcatcaaaaaacgttcaacgatcatttgatagattcgctgttcgtcattactcaatttttcataacgtgcccgttgctctgtaggcaacaaggcatggtgatccgtaactttcttatcattaaacacagcttgctgctgaacttgaccgccatttttcaaatagcttttgacttcaggagcaaaatcggccactgcttgcaaccgttctttcatcgttgctttcatgtcactggttaagtattttgaatcagtccgcggatacgtgacgattttatgggtttcatacaagctttggaccaatgacaacgtttttttggcagaaaagtcatagcgatgattggcttctcgctgaatctcggtcaaatcatagggtaaaggagccgcttcggttttgatcttctcttcaatagacgcaacacggccattttgctgactcatcttttgaaccagtgcttcggcttcgctacggtctttcaattgataaggattgctttgttgccgctttgctttactgtcgcccacttctaagttgatgacataataggtttgggggcggaaaccttcaatctgtttctcttgtgcgcgaaccaaagcaagcgttggtgtttgaactcggccagcgcttaaattatcctgatatttcactgttaaggcacgggtcacattcaagccgactagccagtctgcttttgcccgagcaatggcagaatgatacaagttatcatactgcttcgccggctgcaactttgagaacccttctttgatagccttaggggtctgagaggaaatccaaagccgcttgacaggtttgtcacagcggacccactctaagatccatcgggccaccaactcgccttctcgtcctgcatcggtagcgatcacgacttccgacacatctttgcgatgtgccagttgtttgattgctttcaactgatgccccgtcttaggcaatggtttgatcccgatcgttttgggaaccatcggtaatgtttccatctgccacgaggcccattctttgtttaaatcttcgggcatttttagacctaataaatgaccaagggcccaagtaacgattaccttgggtccttcgtaataatttttatttttttgattacaacccaatactttgctgaggtctttggcaacgcttggcttttccgctagaattagttgtttcataaaaatctttcctgctttcatcgacgacttgttggtattctttaagtagtgccaacccaatatattgttggagataatcgtcgcattcttcacaccagcgttcttcgtcttcattccaaaaagccgtcataaagttggtttttgcatttatgtacgaatactctttccgaatctcgtgccatttttcttcgtaaaatgactgtgcttccgcaaaagatgcaaatgtgaacgcctcttgaatatctgcctgccatccttcaaaaaaccaccatggctcgttatcaccatacatgactattacttgatacatcccatcgctcctctcaagattcctttcccatattagtcacttttaccaaaagttgcaaggaataagtctcaacaattaagcaccctttaaaaaattcaaaaaatcatcgtttttttatgtttttatactgtctcttaagatgacatcaaaatgatgttacccttagtctagcatagaacacagggaatgtgaatataacaagaaaagataacaactctacataggtgaaattattttacttggaaaatttttttatggcaagaacaattatgttacactaaacaaaaaatctgttaggagttggcgcgttgatgtaccttaatcaaattacttttcctgatcgtgaatccgaagggtcattttttgcggggattatgcgaactgtctatgattcctattacccctatcaagtcttgtcaaagaacgccttttctcaaatcgattttgaaccaatcactatcctttacggaggcaacggttcaggaaaaaccaccgcactgaacgtccttgctgagaagatcggcgcgcaacggtccgccgcttataatcgttccaacttctttgaagattaccttgatcaatgccattgcatagttaccaacgaacctaaaatcaagcaaattttgaccagcgatgacgtattcgactatatgctcgacattcgcaatttgaatcaaggcattgatcgccgccgagaagaaatcttcgacgaatattttgaagccaaatatgcaaattttcgttttaaaggctttgaagactatgagagattaaaaaaaatcaacctcgcacgttccaatacacaatcgaaattcacacgtaaaaatctgatggataatgtccgtgaattctcaaacggagaaaacgcggcaagctttttccaagaaaaaatcgtgcctaatggactgtatcttttagacgaaccagaaaattcactgtcggcccaacgacaaattgagttagtcgcatttatcgaagacatgacccgctacgaacattgtcaatttgtcatcgctacccacagcccttttgtcctctccatcaaagaagcaaagatctacgatttggatcaaaagccggtggatgtgcgtcgctggacacagttggaaaatgttcagacctactaccgctttttccaaatgcatcaagaagcttttgaagatgaaaaaagacgtaccgatcaataagaatctcctagaatcacatagaaaacgatccgaaagatcatgcctgcaaatccatacaggcatcactgatcattcggatcgtttcaattatcactgctgcaatcgttcgaatcgtttagacatattgcaattcttttgcttcttggtaagcggcatcgatcaagccaccgccaagacattccatgccatcataaaagaccactgcttgtcctggggtgattgcccgaacgggttcatcgaagatcacttcggcacggtcattatctagcaagcggacagagacgccgacatcttgttgacgataacggaatttggctgtgcacttgaattcacttggacgatccgtgtctgtcgtaaagtggatttgacttgcttccaaccgatccgcatacaatgctggatggtggaatccttgtcccacatacaatgtgtttgttgctaaatctttgccgacaacaaaccacggttcttgtgaagtgccgccgccaccgattcccaatccttgacgttggccgatggtatagtacatcagaccatcatgttgtcctttgacttcaccatctaatgtgaccatgttgcctttttttgctggcaagtaattgcttagaaattgtttgaaattcttttcaccgataaagcaaacacctgtagaatcttttttcttagctgttgctaaaccagctcgttcagcaatggcccgtacttcagatttttccatgccgcctaaagggaacatggttttactcaattgtgcttgcgacagttggctcaagaaatacgtttggtctttgttgctatccactccgcgcagcatatgggtaaccccattttcatacgtttcgacttgagcatagtgtccagttgccacataatcagcaccaagatccatggcataatctaaaaaggccttgaatttgatttctttgttacacataacatctgggtttggtgtacgtccagctcgatattcagctaagaaatattcgaaaacgcggtcccaatattctttttcgaaattgactgaataatagggaatgccgatttgagctgctactttagccacatctttgtaatcttccgttgcagtacatacaccattttcatcggtatcgtcccaatttttcataaagatcccgacaacatcatacccttgttctttcagcaaaagtgctgttaccgacgagtccaccccgccactcattccaaccaccacacgggtgttttcgttagacatgatttttcaccatcatttcaattatagattctgaaatcatctacgatttgaaggtcgcaacttttcagtaatttgcattatacaacagattggcaaaaaattcacggagagtttcatcggtttagcttttcctgtaaaaaacttagatacttctttaaattcaaaaaaacctttcccacataaatagttcctccgacagctgctgcttaagcctaatgctagcctgctttcaagcaaaaagaaactatcataaaatcgtatgaatttcttcataaaatacagaaatgtctgttgcaaggatcagctatactcctcttagataatgacaaaaggggtaacagaacatgaacaatcacgcaacgactgaccgcagaaatagaaaaaagccaaaaaattccgtcaaaaaaagtattcttgtcttactgatcattgtcgccggttctttccttttacgacaattagtctttgaaagagtaaagcattccgactcacaagatatcgtattattgccaaagaaattttcagagcaagccaatcaagtgctgcaagaagtgctgccgaagtcccaacaagtccctttgattttgcaaagagacgaacgttgggggatgaaacgttacggctctggggaacagcaaaatacctttgccgataatggttgtgccatcgcatctttagcaatgattgattctttttggcgaaatcaggcaccagaaccagacaatattctcaactgggcaggcaaccaattttatcttgctgatcaaggaactagctggcaaatctttcctcagtttgccgaacattttggctatcaattcttagatctgggaaattctttcgaggaagcttacaagatgattcagcaaggatttcccgtcattgtctccgtacagccgggaacatttactaccacaggccatttgatggtattggctttgaatagagaagggaggattcaagtgcttgatccaaatgattcaccagataaaaaccactacaaaaaaactttctctaatgaactgcttgctgctgaaggattgaattattggtgcttttggctttgattttcaaaagcaacttacagacttgcactgttgactgagaaccatcaaaaaaaaacagactagccgattagctagcctgtttttatatttgccgtaattattgaactcgtggttcgttgttttcttggatacggctggcagttttgttgaatgcgcctttggctttacgtgtttgttttgaagcaaattctccagttgtttctgcagcactgctaactttgtcttgaacagtttctgaatctttttcgaattgttcacgagttttaacatctgctacattaacgttcacttcgataacttccaagtttgtcattttgttgacttgtgttgaaacgacttctttgatttggtcgtaaatggcagtcatgtcgctaccgtattctgctacgatatctaaatctacggctacttgttttttaccaacttcaacgttgataccggaagtaacatcatccgtattcactaattttcctgcgatatttgagaagaacccaccatcaaccgttaatagtccatctacggattctagcgcaatcccgacaatcttttgaattactttatcttcgtaagtcaattctcctttaacacctgcagtagttgttggttttacttgattttccattgtacattcctcctatatcttcataaaaattataataataaatgttaccgatcactaacgccgcggcttttgaaattgatcaaagaaaccgatctctttgaggtagaagccaaggtaacctcctagtgctgtaaaaatcagtagtagcaatgttttcaaaaagccgactgtcagaaagagaattgctagtatcagtcctaatgcagcaaagataaccgggatcttattttgttcgaaccatttgttcatcatttctcctcctaaacgacacggggttgtgtgtgatgttctcttgtttcttcagcgtctttcaagacaacttctgtttgtatatcatgagtgacaccgaatagcgtttgaagcttactgctgatctcaccaaccaatgcttcttgttgttgcgggatggctgcggtctgtttcatttctccatcgatcatgactcggactttattcttgataatcttgaccttcactgatggcgaatggataaaatcagcttgttggacattctttaaaacaaaatgttccaaggctttcttttgaatcaccaattccccggatttttgctggataaccaaacgatccgaacgctttggaaagaacaagacaacgaaaataccaatgatcgtcagcagtgcaaagccgacacatgtccaaaacaaaaacatgctcatggaagctccgacccacggatactcacgcagtggaatcaagtagaatggtaaatctaccgcttgctgattctcaatcatgccaaagaaaaagacgagcaacaataacagtaacccaatgatcatgatcactttagaaatcttacgcataggcaacctcctttactactttctatttaaagcatacacatttcttaaatatccttcaaatgataaaccttgaaaccgattattttttcattctatgaccaatgttcagcttactagaagcagaaattttgtcttgctattataactattgttaaaaagatatatgactataattctttaaccgactgttttccttgttatttctcaatgaaacgtttggtgtatttctgcttgtttggcttgaaagatcctttctaattggttttcggaaattggtcgtccaaacggccaaggttgaggaaggaatgctaattccggcgcatcgacaccgacattgatattctcagcgataggcaaactatgatgatggatatgcccatgaaggttacggctattctttgtcattcccaatagcatcggataatgactcaaataatactggtgatgatcaaattttaacaacagaccgacatccgcaaaagaaaacttcggctctccggaaattccgggatcgtgctttgctagataacgaaagagtgcgcgcgtatcatggttgcctttgataaaagcgatctttccttgcagccgtactaatagcgctaaaagctctgcaaaccccgcttcatgttcgggatggagtgcaatatctcctagatggtagaccgtatcttgtgcttgaaccacctgattccaattagcgaccatgacttcatgcatctctgagacagacgcaaacggacgtggggcaaaatcattcgaacctaatagtttttcatgaaaataatgagtatctgatgtaaaatagcgcatcttctcttcctttctcagggtaaatgttttacatatctgtcagtatacgcttagcctaaaaagaaaacagcaaacaaaagccatgattgaagtcacgatctttccttcaactgtaacaaaaaaacaaccgaacgatttcatttctgccaaagagcaagggacaagtcacaacaacatccacattgatagtgtggaaccgctaacgtagtggattagcgctagcctccacactcgctactgtggacgatccaacattgtccacggaataatttgttcatgattgtcttccagatacacttttgaaacgaaaatcttttggttgcttttcctaaataacggatcattttgttcgcgatggtttacgctttgatgaataatccgcgactaataaacccatccatcaagaaataaaatttttcttgcagcattttgtgttgcgggtctttaaagatgttgactgctttcaatccattggctgtcgtaatcgacatcttaaacgttttgatgtcctttgcgacggtgatttttaatttaaagccttctttactttgcggagttgcttccaacccgcggatcagttggaaattgccactgtttgtttcagtaaatccattgtcccgcagtgtatacttttttgcttctggtgctaattggtagcgggtctctgcacctaagacagttgttgttgtttcaaatgccatttgctttccacctcgttcgacgttttgatttccgaaaaagcttctctagaaaaaatacaagtgcttttttctagagaaagtctctttgctatccggtatttctttcttcagattatcatgaatggttgcatgagtgccagtttttttttgctttctgctctcttttcgcttatctaggagcagccccttcgattcctctaaaaacacgaaactatgggtactacttcttcgttcctaaaacggttcgagcaagtaattctgcaaaactatggacctcttcttctgtgttaccaagaccaaaactgatccgcacagattctcccacagcgggatgctctttgccatacattgcttctaaaacatgagaaggttccacgttccctgcggtacaagctgaacccgtcgagatcgcaatgccttttagatccaatttcatcaacagtagatcactagtaacaccaggaaattgcagattgatgatgtgaggcagcttgctatcaggatctccatttaaacggtagtcaacgctttgctcttccaaaacagaaaaaacttgcttagcaaattgctgatacgtctcactgtacgcacgctgtacttctggagtcagcaaggaaacagcttttgccatacctacgatccctgccaaattttctgtaccggcacggcgcttttcttcttgctcaccaccgtgtaagagagtgggtagtgacaagccgtctcgtttgtacaagaaaccaacgcctttaggtccgttgatcttatgtgctgaaatactcaacaaatcgatgccatacgcagcaggatcaatgggcagcttgccgtaagcttgtacggcgtccgtatgaaaaacagcggcgtgttcttttagcagttcgccaatttcttggatcggcaaaatattgcccgtttcattattggcgaacataattgaaacgaggatcgtatctggacgtagtgccgctgctacttgttctgataagagctgtccttttttatcgacaggtaagtaagtgatctcgaacccttgcttctccaaaaacttcatgctttcgatgactgctggatgttcgatcgtcgtagtaatgatgtgttttcctactgcttgttttgcatacgcggtgccgaggatcgctgtgttgtcgctttccgttccgccactattaaaaatgatctcgtgggctttgacacctaactgatcggcgattacttgtcgcgcttcttctagcttggtatgggcatcccgaccgtacctatggatactggaaggattgccaaaaaatgtcgtcattgtgtcattcatggctcgaatgacagccgggtgcatcggcgtcgttgctgcatgatctaaataaaccattcgtttcacctatcctttattaaagccattataacaaatctaaaccaaccgtctatccctaacgattgattttccggtagtttaaaagaatagcaaaaaacagcaagcaggttttcttctgcttgctgcgaatgatttggttcttcaatgtatttttttagaaaaagtaatcacttatgcgttctcaccaggttcagaggcgatcaccgtcagttttccctgtaatgtccattttttgattggattaggcagaatacagcttgttcccatcttcaattcataggaatgaccatcgatcacaagttgaccatatccgtcaatcacggtcatcagagtatagtctgcttgttgttccagattcaatttgccacgaacttcccattcataaacattgaaaaattcggtttccagatacgtcacgattgccgaagatccttgcttgatttcacgaatcgacagttctggtgctttagcgggcacagtcgtcacatcaacagattgttggatatgcagttctctggtcttgccttgatcgtctgtccgatcatagtcataaacccgataagtggtatctgaactttgttgtgtttccaaaatcatgatgcctttaccgattgcatggatcgttccgcttggcacatagaaaaagtcgccttttttaacaggaactttcgttaatagatcatcccaacggccgtcttcgatcattgcttttaattcttctttggtttgtgcgtggtggccataaatgatctctgccccaggttctgcatcaatgatgtaccagcattctgtcttgcctagttcaccttcatgttccatgccgtacgcatcgtctggatgcacttgcacagatagatcgtcttctgcatccaagattttgatcagcaaaggaaataccggcgcctccgaatgaccaaacaattcttggtgatcccgccataagtctgctaatgtcttccctttaaatgggccgttttcaatcacgctgacaccatgaggatgtgcactgatcgcccagtcttcaccgatcttatcatttggcagatcaaaaccgaaaacagaatgtaaacggctaccgccccaaattttttcttgaaaaacaggtttcataaataatggttccatagttgatcccctctctattgattcgctaatattatagcacgaaaaacttcaacgaacggattcttttaaataactttgtacaatttgatcccgatgtttcagatagctgtctctgtgatcctctggatgtacgcgattcgaaagaaaaataaatgctttgccatcagaaccaatcaaaaggaaggtccctgtataccctgtatgatagaggtgtacaggcgtacctttcaagtcccagccgattgagcgatgtcctgtttcagatggcgtatggtctagatatagtctttccagtatatctgctgaaagaaaagattgcgtcgctgtctgacctttcttcaacatcatttgtacaaattgagtcaaatcatcaatggttgaaaacagccctgcgtttccggcatgtttgcccaaaactcgtgctttgggatcatgggtgattcctttcagaacagtcccatcttcttggcgctgagtggctgctaccttgcttgctgccggcaaaggaggaaacccactgttggtcatttctagcggttgcagaacctcctgctggaagatctcggtgacagaacagccaaaaagttcctccaacatgaagcctagaagaatcgtgcccgtatccgtgtactggacttgcttgtcaagctgtggtccgctttggactcgaagatacgcgtgacgcagctcttcagcagacaattgatcgcggcgaggaatccaagtctggatatcggaggtgtgggttaaaagatgtcgtaacgttactttctgatcagtaaaagcaggcaaatagcggaccagagggtcatcgattgctaggactccctgttcccatagtttgagaatcaccgtcgtcgtacaaaccactttcgtcaaagaagccacatcaaataggtgttccgtcgtaagtgattctatttggggctgccgagccgcgtagcctaaacaatgagtctccatttgctctccatggatgaatcgataaacaactcccggtaagacgccctcctgttgcttttcagcgattagccgaatcgtttctggatacataccagttcctcctttcgtgcgcctctaaactgttttgattataccagtcaggccctaattgcacaaaaaaatacagaagagatttccagagaaattcttctgcatcttagtggtgaatcgcattatttatttgcaacgaaccaccattcgatcccgatggtatcgtaggtagtcagtaagtttttctttttatcaataaagaattcttgcttgctgtcagtcaaatgagcttccaaagtcaataagtcttctttatcaatagcgatcttcaaaaagtccaatcccaatacctcatgtgtcggtaaatcgatggttccgccttggccttcgatcaaaccaacttgaaaatcatcttcattcaaatgtaagaaaccatctgcttctttggtcgtcaaacctaacagctcttccaaaaagtcgcgttctttcgctacatcactgacattcagatgaatttggttgaagcgagctttgcttgataacaggactacctcacttggtgcagcttcgatcaatgcttcaagcgtttttggcaaatctgtttcttgagtgccttcgtaaaaaacttcgattcggttttcttcaggatcagccaaaacaactgcgatttgacttccttcaaaaatagattcttcaaaagtcgcagactgttctttcgcttttttacaaattgctgccagttcttctaaggaagcgacggtcaagcggatccgttgcatttttttgatttccccaaaatgatcattggcccgtggactttcttctagccagatgacttcaccttctgcacctttgaaacccaaaatggctaattcgttttcttcccgtttcaaatcaaaacctagaacatcacgataaaaagcaatctctttatcccgatcttttactcgaatcgcgattgtccgcaactttgtgctcttccccaatacaaaatctgtcattatttctccccctatatatgtatgcgtttatctatgcatttgtccttattgtactgataaaccgttatactagcaaatgaaatcctttatcattctaccattatcaagcatttttttttgacaaaaaaatagatttaacgacaaaaaaggtcactgaacttctttttttgtggttaaatctacctttattcattgaaggaaggctgtttctttcattcttctgatctgagtaccgtttttttctaatcggtcggtgatactgacagttgctactccgctcataagcgcttttttagcactgactaactttggcaacatcccgccagtgatcaccttctcattgatcaatgtttttatgtcagtcaatgagacttgctgcagccactgggagtctttcttgattcccggtacatctgtcagcagaatcaatcgttctgctctcagactgctggcaactttacaagcgacttcgtccgcattgatattcagccactggccttcggctgtgatcccaagtggggcaaggatcggtatatgattgcctttgatcagcagctgaagcaactgctgattaatagtcttagccttcccaacatagccaagtgtggcgtgattgatcatttccccttggatcaactgatcacagccagcatttaagccgattgcctgaaatccagcttgctgaaaataagtcgtgatcattggctggacttgtcccagcaaaaccatgcgagtgatctcaagagtttgcgcatccgttaccctcaagccttctttgatctgaatcggcagtgacaatttctgcagcatttccgagatataatggccgccaccatgaacaatcacgattttctttcctagagcttgccattgtgcgacttgttcaaaaaaaacgggggtcagattatctgaagcaacaccacccatcttgatgacaatgatttccatatgttcttcctcctgttggatcttgtggcgattttttgattcttacagccaatgattccgattctattcgtttgatacctccatgagataggcattacgtatgatagagtgcattgattttgacataatcatacgtaagatcacagccccaagctttcccgcgaccggccccttcttgtaaaatgacattgatttttacttctgaggctgtcaagcgttcttccatcagtgtttcatcgtagtcaaggggggatcctcctgcaaaaaccgggatcgccgctaattcgatcgccacattggcaggatcgattctttgtccgctatacccaattgcacaaaggatccggccccaattggggtcttttccatagattgctgttttcacgagtggtgaacctacgatcgttttactgatcatgcgggcagctaagtcggtgggagccccttttgtttcagcttcaatcagttttgtcgctccttcaccgtctttagcgatggctttggccaatgtcgttaagactgtctgtagcattttttgaaattgcttataagcaaatgtattttcttcaatcggcggattgcccgcttgcccatttgccagcaccaataccatgtcattggtggaggtatcgccatctactgtgatttgattaaaagtgacttccgtgagttttcgcagcaatgactgcagaagggacggtgcaatagcgacatcggtagtgacgaatgccaacattgtcgccatgtttggatgaatcatccctgagcctttggcgcaacctgccatggtgacagtgtggcccgcaatctccgtctgaatcacttgatttttttcaacaaggtctgtcgttaaaatggccttctgaaatccggtaggactgccagaatgacttaattgacgaatcccagcagcaatcgttgccatcggtagtggtcgaccaatgattcccgtagatgccaccgccacctcttctgaggccactccggcttgtgctgcagccaaagcgatcatttctctggcatctgctattccttgttctccagtacaagcattcgcattcccggaattcacgatcactccccgaagctttcctgttttcaactgttctcttgttactaggacgggggccgcttgtacttgattggttgtgaaaactgcggcggcacttgccggaacttcagagaacaaccagccaagatcggcttttctttttttcaccccacaatggatgccatctgcataaaaaccttttggtgaaacaattgtccctataatttctttcatgttacacgctccttattctgaactaatcgaattcccaagtatcgttaaggataccaagggatctgtcgtaatccagctgtttcctccagcccagcccatttattgacgttctggattgcttgtccggcagccccttttactaaattatcgatcaccgcaatgactgtcacgatgtgggtcatcggatttaagaccaacccaatgtcacaaaagttggttcctgtcacctgccgcagttctggcagctttcctaacggctgcaagcgaataaatggttgttcttgatagtcttcttgatacctctgataaatatcttccgctgttctttctggcgctacaggcacataaagggtcatcatgatccctctgttaaccggaatcaaactagtggaaaattggatggccgtcaattctggatcccattgttgaaactgctggacaatttctgggatatgctgatgctgattcaatttatatgtctgcatattttctgaaattgtcacaaaatgactggtatctgacagttttttccccgcaccagaaagcccagatttgccgtcaaaaatgggaatgcctgccaaccattttcttctgactaaaggcgcagcggctaaaattgcggcagtggcatagcagcctggattggccattaaatttccgtgggacgtctgaaactctggcaatgcatatgttgcagcatgcaataaacgatccgcagctggcgtctgctggtaccattgctgataaacacctgcttctttcaaacgcagatctccggataaatccatcacaggaaagtcttgttcgacaaatggcgagaccaaatctttgctaataccagccggtgtcgcaaaaaagaccaattcattttcttgcataatctgcagcggatcaaacgggtaaatcctttggttgaccagttgctgcagatggggataaacattgactgaattttcttggactgaatgactatgtaacgttcctatctccaagacaggatgcaagtggatcaaacgaaccaattccaatcctgtatagccggtaaacccgacgattgctgctttcacttactacacccctttttcacttgttctcaaattctttttcaacaacctttcaacaaccaaagcagctcttctttcttcattctcacctttcagtggtttcttctttcgttcctaaaacatgacgtagaacagcgagtccttcagccatttctgcttccgttatggtcaatgctggcagcagacgcaggacattcgttccagctttcaacaccagtaaccctgcttgacgcaattctgtcatcgcctgttggagagcagtgctatccttcaactctaagccaatcattaggccctgccctcgaatagccacgatctgtgccagatccgttaagcctgccataagctgctgatgtctggcagcaacatttactaacacaggggaatcggttaggaccgtacatacggcatttgctgcagccatcgctaacaaattaccaccaaaagttgaaccgtgacttccagggccaaacccctgctgtaaatcagtttttcctagcatggcaccaaccggcagcccattgcccaacccttttgctaatgtaaaaatatcaggttcgatcccatattgctcaaaagcataaaaactccccgtgcgtcccattcctgtttgaatttcgtctatgatcagcagtgcacctgcttcttgacataacgcggccaccttttggacccattctttttcagctgggatcacgccgccttctccttggaccagttccatcatcaccgcagctgtttcctcatccaacgctgcttgcagcggggaaaattcattgaagggcaaatactcaaaatctggtacgagcggaccaaaatcctgatggatgctttcttgagccgttgctgtcatggcaccaaatgttcgtccgtgaaacgagccctcaaaagttaaaatctttgtccgacccgttgcttttcgagctagttttaaggctgcttcatttgcttcagccccactattgcaaaaataggcaagatatggaccttttgttagtttttgcgcgactgtctcttgtaacgaattggtgtagaggttgggcgcatgccataatttgtccgcttgctgcagcattgcctgctggatttcaggctgcccatagccaaggttgacgaccccaataccgcttgtaaaatctaaatatctccgaccttgagtatctgttacatagctgccctttcctgcagcaatctctaatggcaaacgtgtataattgggaaacaactgactcatccatcaacgacctcctatgaatatttatgtattaatatacatttttagcaaataaattgcaatatttatttattttataacgaaaatattcattccaacaaaaaaaaagagaagcttaacgcttctcttcattcttgtttatattcacaaaaatcgattgaataaaatcgttgtcttcttgtatcaggccgcatcatctgaaaattggctgttatacaagtccgcataaaaaccattcttagccatcaatgtgtcatggtttccggtttcgacaatcgaaccatgattcatcacaataatattgtcggcatcccgaatggtagataagcggtgagcaacgacaaaacttgtccgattttccaacaatttgttcatggctttttggatgagaatctcggtccgagtatccacactagatgttgcttcatccaagatcaacacatctggatcagctaagaaggcacgcgcgatcgtaatcaattgtcgttgtccttgagagatattgctagcttcttcattgaggaccgtatcatatccgtccggcagcttgcgaacaaagtcatccacgtgagcagctttagcggcttcgattacttgttctttcgtcgctttgtcattgccgtaatggatattgtcatagattgatcctgtaaatagccatgtatcttgtagaaccattgatatgttgctacgaagctcatcacgggtcagatctcttgtgtcccgaccgtcgtagcgaatactaccgccggaaacatcatagaatcgttccaacagattaatcaatgtcgttttaccggcaccggtaggtccaacgatagctaccatttccccagctttgacgtctagattaaaatcggtcatcaataagttgtctggtgtataaccgaattgaacatggtcaaaacgaactttatagtcgctttcttccacgggtaatccagaaggttcatctgacatttcttcttcatccaagacctcaaagacccgttctgctgatgcaacagttgattggatcgtattcaataaactagcaatttgagtgatcggttgtgagaattggttcgtgtattgcaagaatgcttgcacatcccccaaagtcatgttcccattcgctactttgatcccacccagaactgcgacaaagacatagcccaagttcttgatgaagttcatcaatggcataatgattgcggaaatgaattgtgctttccaaccagcactatacagacgatcgttttcttcttcaaatactttttgatcagccgcttcatggttaaaggttttgacaacggtatggccgccataggtttcttcaacctgattattcagtaatcccaagctcttttgttgcgcagcaaagaatttttgtgattttggtgcgacgatcattacgacgatcaagcttagcggcaccgttgctaatgcaaccaatgtcaactgccagctaatcgttagcatcatccacaacactccgactaaagtaacaaaactggtaataaattgggtcaagttttgttggagggtgctggcgatattatccatatcattgattgcccgtgacatgatatctccgtttgaatgggtatcatagtaagaaatcggcaagcgattcattttttcttctaaatcacgacgcagttcatagacggtccgttgtgatacacgggtcatgatgaattgttgcaagaaattgaaaatagcagaaataacatacataccgatagcgatcataatgatttgtcctactttatcaaaatcgatcggaaattcggtgacagtttttccagctttcatttgctctgcgccaatcataacacctttaaagatttcggttgttgcttcccctaagatctttggtgtttgaatctggaagattacggcggcaatcgctaaaacaaataccgaaatgattgcgatagaacgtttcgacatataaccgaaaagtcgttttaccgttccccagaaattttttgcttttggtcctttcgctccaatgttgcgccctggaccgccacccatcggtccaccgccgcgaggtgcttggtttttccgttcactcatgccacatcctcctctctcaattgagatgatacgatttcttgatacgtttggtttgaggccatcaattcttcatgggttcctttacccaccaattgaccttcgtcaaggacaaggatcgtgtctgcatccattactgtacttacccgttgtgcgactacaaccataatgctgttcttcatgtcttttttcaatgccgctcgcagctgtgcatctgtcttaaagtccagcgctgagaaagaatcatcaaacacatacacatcggcttgtttcactaatgcccgagcgatcgctaaccgttgacgttggccgccggagaaatttccgccgccttgttctacatgactgtctaagccttcgctcaattctgaaacaaactctttggcttgtgcgatttccagtgctttccagatttcttcatctgtcgcatctggtctaccgtatttcatgttttctcgaatcgtaccagtaaataaaaccgctttttgtgggacgaaaccaactgagtcccgcaaattatgctgtgttacttcagcgatattcactccattgatgcggatcgctcctgattcgatatcatagagccgaggcagcaaattgaccaatgtcgtcttcccagaacccgtaccaccaatgattgccacaaaatcacccgattttgcttgaaaatcaatgtcttgcagtgctaatttttctgcaccgtggtaacgatagttgacgtgatcaaaagcaagtgtggcttgatcaccttttaattgaatcatcttaggtgctttatcatcaacgatctcttcttcttcgtctaatacttcattgatccgatctgcagaggcttgtgctcttgggaccatcacaaagatcattgacagcatcataaaactgatcaagatttgcatggcatacgtcatgaatgcaatcagattcccaacttctaatgtcatttcagcaatataatgtccaccaaaccaagtgatggcaatattggtcccactcataatcaatgtcatcaaaggcatcataagtgccacgatagtatttactttgatggccgtgtgggtatagtctttattggcttcatcaaagcgattggcttcatacccggtcttatcgaaagctcgaatgacccgcactccagtcaatccttcacggaagaccaaattcagacggtcagtttttttctgcatgcttttgaaaagtggcacagcaaaatacatgattccaccaaccaaaacgatcataattggaataacgactaaaaagattttggttaactgagcgtctttttgataggccaagaagcttgctccgatcaaagtgattggtgcattgatcatcatccgcaagaacatttgtgccaccatttgaatttggttgacgtcattagtcgtacgagtgatcaaagaggcagttccgaatttatcaaaagaacgtgcggagaaattttctactttttcataaatatctgtccgtaatttttgccccaatttttgtgattctctagtagcaaagaatgtattgcctaatgcagccagaatactgatcagtgaaaaaccgatcattaaaaagccggtacgccagatataatcaatgtctccagttgcaacgccattattaatgatattcgacgttaatgtcggtaaatagagatctgctattacttgtacaaccataaaggcaacggccatcagtgccgaaacgagtgaaactcgtttaatcaactttgtcattcttttcccctctttctttttgtgcgccatctcttagccagctgattttgttattgaaatcagtcgttgctagcgaaggatcataggcatgattttctgctaactctcggtatgcttcagcaatcgtagaaaaaacggtgtgcatcaacagttggacgagcattttcaattcatgatcatccttgacccgtaataagtctttgtcgatctcagcaaaaaattcttcttcccacttctgtctcgcttcttgatgctctttgtgagagccgtagagtggttttttgtggatatccggcatcacttttcgcaaagaacgataatccatactcatgaagagattgcgataaaattttgcattttttccttctaacacttcttcgatcatccgagaaaaataccattcaaagccagcaaacagatcgcccttttcgtgttgaatggaacgaatcaaatcccgctgactgttttttttcaacgtatgaaaatagtagtagtataagtcttccttattttcaaaatactgataaaaacttccccgagggatttctgcgtctttgatgatattggcaatcgaagcatccttcaatgggacccgagaaaattctttcttagcagcgcttaaaatgcgtttttgcttatctaatggcaaatggaaaaacgtatccgttggcatcgtcatctctcctttcagttcaaatgataaatgacaacaattattatgacaggttgtcatatgacactgtgtcattatacacccctcatgagagaatgcaagtaaaaaagtttgaatattttatgaaagtcattttctttataaaaaggaaattcgcttagtgatttcatttcattgaaaatagattcattgtctttttctgaaaacaaaaaaagcagcggctattccttaagaaaggaagccactgcacaacagccgtttttcgattttaaataacatctattttttctttctaacccacaggacacagcctactccgactaacaaaacgactccaacgactggcaaaaaccaattgacggtctctcccgtttttggcaatgctcgactgtccgaagtagcactagctacttctgttttgctagttgttgtttgttccgacgaagtgttggcagcagatgtatcagaagattcggtattccccgttacttcagaagctgctgggagataatgaccttgattcacagcgtaaatgatccagccaatccgacctggaaacaatgtttctgaaccactggtagctacttcttcatctaagtgtgacaaaatcgatgtcaaccattcatctgaaattggctgttccggggaaatataaacaccatttgttgggtaaacaacttgcagatatgtttttaagcgatccagttctggaatcaacgctgcaaaagaagagtagctgcttggatcaaaggctagctgcggttcaatcttctcccaagataagagatgatcgataaaaagagcgcgaacgatccgagcaaaatagccgatatccattcccatcacatcttggctatatcgtaatgctagtgtctctgcatcttttaattgctgatcggtcaattgatccaactcatcttgcgtgaaagctgtcacacttccatcagtgatgcctctagtaaaagcagagcgcaaatcactttgttctgtaatggtttctgactcaggacttgcttgaacgcctgtttgagcgacaatggcttctaccacatcctcgggctgtgtcgtcacggattcactactttgtgcagtgtcagcggttgattccatttcagtattcgaaaccgtcgcttctgtcgaaatgatttcttcagttgattgcgtagattgaatcgtttctgatgattccgttgtttcctctgcaatggcagtaattggtaaaaataatagacagctcatgaaccagatactctttttcattcctttacctcctcaggattctcaggatttctttgtaacacgaatgtaacacaatagtaaattattcgcaatgtaaaaaggcacttccttaagaaatttaaaagatattcaatgtcttccgatgcactccgcttcttccctaacaaaaaatcccgaaccacttcagatgattcacattaacagaagcattaacgagatcatcattcagcagtacgggacgaagcgttcttaatcaccgaatgacacatgggtagaaaaaattgtaccattcgaatctagctgttttttaactatttgacttgtacagtcatcacaggactagcacttgtgactgttcctttagcagtcatggtttctgagataacttgttccatattggtgagtaccacaagcatatcagttgctttattgctagctgccaattctgccagatcaacttcagcaacttgtgtagcggcagtcacttgttgcccttcttggacgaggatattgaaaggcttgccttgtagctcaacggtatcgacacccatatgcagcagaatctcaagtccatttggtgtcgtgattccaatggcatgtttggttgggaagatcgttgttacagttcctgcagctggtgcatagatttttccatttgcaggagctacataatatccgtcacccatcattttttgagaaaaaacaggatcctttgactctgtaatcgcatgaacggttccttcagcaactgcatatagttcaatggtttcaggtgctgcagacgttgctggtgttgtagccgtcgttgaagtagccgccggtacttcttcatcaacagcattgacagcagctaaacggtctttaggaatcccaaagaagtaagtagccacaaagccacctgcatatcctgctaataaaccaaagacatagcctaaccaatgaccgttcgcaatcaacggaatcaaagctactccagaaggtccaatggcggtagcgccgatattcgacaatgcgccgataaccgccccaccgattccgcctccgatacatgccgtaataaatggtcggcctaatggcagtgttacaccgtagatcaatggttctccaatacctaaaatccctactggcaaagcgcctttgatcatttcagaaagttctttatcttttcgcagacgaatccacagggctaatgccgcccctacttgaccagcgccagccattgctaagattggcaataactgtgtgctgccagttgcttcgatcatttgaatgtggatcggtgtcaagatttgatgtagaccaaacatgaccattggcaagaaggttgctccgagaacaaaacctgagaatgcgccgccgacatttaatacccaattgattgagccaaccaaactgtctgaaataaacccagctaatggcatgatcaaaaagatctctgccaaaccgatcgctaacaaacacaaagttggggtaacgatgatatcaatggcttcaggaatcactcggtgcaaaacagtttccagtttagccagcaaccagactgcaaagatcacaccgatgatccctccttgtccaactgccagaggatctcctgtaaagaggttggtgattggggcttctggattcattccagtcaataagacgaccgacccaatgacaccacctagcgttgggttcgctttaaatacttgagctgcattgacacctgtgaagatcactaaataagaaaacatcccgttttttaagatatttaaaatcatgacataataattccacgtgtcgccatcgatttttcctgcagtgatcaagttcgtcataacagaagcaataccagcaacgagaccagcaccgacaaacgctgggatcattgggacaaaaatattcgaaatatctttcaataatgacttgattggtgattgtttttgtttcgctttttgagcagctttcatttctgctgctttcgcattcacagcctcttttccactggtggctgccacaggaatttcttgccctagatcaacacccgcttgtgccgccatggcatttgctactttattgacttttccaggaccgatgatcacttgcagttgttcatcgtccactactcctaagactccgggaatgttttgtaacccttgcttgctgaccttgttgtgatctcgaaccgtcatccgtactcgagtcatacaatgagtgacagaggcaacattctcgataccgcctgattcttgaaatattttttctgctagttgtgtaactgtcagttcttcttttgccattgattttttcctcctatccttctaacgttcctttaacgaacccttctgattgtaccagctttgcagcagcttcttctttttcactattggtaagcagcataacgatcgctaacttcacattttgatcggctttttcaaagtagtctgccgccgtttcataatctgcttcggtggcttgcatgatgattctcttggcccgttcaacgagtttgtcgttcgttggtttaacatcgaccattaaattattgtacacttttccgatgcctaccatcgaaatcgtggaaatcatgttcaaaatcaatttttgagcagtccctgatttcaatcgggtagaacctgtcagaaattctggtccgcaatccacttcgatcgggaagctggcatgttttgaaatttctgcttgtttgttgcaggcgatcgttcctgtggtagccccgatttcatttgcatagtctagtgctccaatgacataaggtgtgcggccgctggctgcgatcccaatgaccatatcattttccgtcagcttcaggtcaatcaagtcttgacgccctaattcaacagaatcttctgccccctcaactgctacagtcattgcttcttcaccgccagcaatcaaaccgatcaccatatccggtgagaccccaaaagtagggacacattcagcggcatctaaaactcctagtcgtccgctggtaccagcaccgagatagatcaatcgtcccccttttttgaaagattgaatcgtttgctgaattactttttcaatgcttggcaattccttttcaacggattgagcaactttctggtcttcggcattcattttctgacaagcctctgccacagtcatttcatccaagccaaatgttgcttgatttcgtctttcagtcgttaagttttctaaattaatcattgtcatttctctcatctctttctattttgaatcgcattcctgctttgatttgttggagcaaggggagatcttcttcaatcacttgcgcagcgacattgactttgtcatctgcgggcaggattcgcttacaaatttggatttcccccatatagcgcaagtaatcttgattatcgatagtcacagctccgacaacccgtttttgagcagtttctggggaaatcaatgggacttcagcaaatcgggcatttgcactgcgaatcacatctcttgcctcatcttgccggctctcatgctctcctaaaatatgttgataataggcagaaccaatatcctttgtgcgaagaaggacggtctgatcggctagataagaactgaattgcttcaaagaagcaggggtcacgataccatcaccaatgtagacagcatcaacggcacaatccctcaacaactccagtgctgctgcgaaggggctcatgctgcgatgcgcttccagtgtcggcaatccttggtaaagaggacctcttttattcgcatccccagcaacaaaggcctgtacaagaaaaccttgttgtttcaaccactgatttttggcctgaaaccattctttgtctaatcccgtctccggacgcggatagtaattgtgccacgcctctagattagaaaaatctgcctgataggtgttcaactcgttaatatctttttcagtcaatgtactcgcatttaaactaatagttattttacgagataattgagcaatggtctgattgtcgatcgcgtaatccattcgcagcccagtgactccccgatccgtcagttcatttaactctttataggaaaatcctgctttagccaatgcctctcctgaaatatctaccattaatgacaaccgattcttttttgctatttcaccaagtgttgtcaatcgttggcgataactggcggcatcatcttctggtatatgcatggatgtaaaaatcccagaaaaaccttgaagcgccatttcttcgatggcatcgatgtctgtggtagtcaaatcggcattcataaatactgaaaacccaaacattgttgattcctccttgctggtaccgttttctacaaaatgattatacaacggcctgtttgtttttgcaactatatttcgtaatatataattataaaaagaaatataatttcataacggtgtattttttaagaaaaagttgtcccttaaactttctaatgcggttcggccattagttgtggtacactttataaggagtcaacgagcgcgtaatttttacatagtaggaggaatcacatcatcaatgattacaatggatgatattattcgcgaaggcaacccaactttgcgggaagtagcaaaagaagtcccctttccattaagtgaagcggacattcaattagggaaagacatgatggagtttctagaaaatagccaagacccagtgaaagccgaagaattgaatttacgaggcggagtcggtttagcagcacctcaactagatatttctaaaagaatcactgctgttttagttcctagtagcgatcctgaaaatccagaacctgaatttaaagatgtgttgtacaatcctaaaatcttaagccactccgtacaagaggcatgtttaggtgaaggcgaaggctgtctgtctgtagaccgggaagtaccaggctatgtcgtacgtcacgcccgaatcacgatcagctattatgacatgcaaggcaagaagcaaaaagttcgtttgaagaactatgcagctatcgtcgtgcaacatgaaatcgaccatttgaatggtgtcatgttctatgatcacatcaatgaaaaaaatcctttctcattaaaagaaggaattttagtgatcgattaacgattagcaaacaagagcgcactcccaagtgggaatgcgctcttgtttactttagtcgtcattcattaggattaatttccctttgccaagctggcttgatggtccgctttgatttgagacaacaattctggcttttgataaagatctaatgcagtcaatgcgagtaattccgctgcgatcgcaatcgagttcagtcctttggtactacgagcagccgctttaaattcctcggagtgaccagcaatgtattcatccgaaattgagacagttggctggatcgtggggatcacttggctgacgtttcctacatctgaagagcctaaacttgcttttgtttccacatcgatctctgcttggggaacgccaacttcctgagtatgggcaaagaatagttcatcaaaacttggtgttacgatcacatcgtcgactgaattctggaagagtccaaattcataagtcgttcctgttgctaaagctgctcctttaacgatattctccactttctcatagacttcatctagtgtcgcccgattggctgctcgtaaataaaaacgtccagctgcatattctggaacaacattcgctgccacaccaccatcagtgatcacgccatgaatgttgacatctttcggcaaatgaagacgcaacccattgatcccattaaaaacttggatcaatgcctctaacgcattaatgcctttctctggtgccgctgccgcatgggatgcccgaccataaaatttgatatcgacaggatcattagccaaagatgcggtggttttgccatagcgataagctggatgcacgcacaatgcagcatcgacatcctcaaaaaatccttcacgcacaaaactgccctttgctgagccattttcgcccccctcttcaccaggagtaccataaacgcggatttctcctcctagttcatctacataaggttgcaacgcactagcagccaatacagaataagttccaaagagattgtgcccacaggcatgaccgatgccgggcagcgcatcatattctgccaaaaaagctaatgttggtccaggtttgccgctttgataacgggcatcgaaccctgtacgatgaccagccacttctttttccacggtgaatccttctttttctaattgggcaatcagcgcatctgcagaataaaattcatagttgctgacttctggatgatcatgaatatccaaagctagttcttggtattccggtaagcgttgtgcgataaattctttaatagaagtttttacagttgttgtcatatgattttctctccctttaatatggataaataagtatgaatagtcagtggtctcacagctcctgcctcagaaaggtaggcattcttgctatactcttctttacttcgcgccaaatgtctcccaggctggaacgctagaacctttcgatgtttcttcgataactttctttgtttcgtccgtttgataagcagcaacaactttttgatacacttcgttgtcttgatcttctttacgcgcagcaatgatgttcacgtatgggcgagccgtttcatctacaggctctaagaagatcgcatcttctgtcggaacaaagccagcatccacagccattccgctattgattactgaaatatcaacatctgataatgcgcgggcagtttgggcagcatctaactcagagattttcaacttttgattgttttcagtgatatccgaaacggtcggcgtctggcctgctgcttcatcaactttgatcaagccagcgctttgtagtaacaacaacgcacggccgccattggtgacgtcatttggaattgctactgtcgcgccttctttcaattccttgatatctttcaccttgtctgaataaatccctagcggcgcattgactgtattgccgatagaaacaagatccgttccaaactctttattgtaattgtctaaaaagaactggtgttgaaaagaatttatatcgatagaaccatctgccaacgccgcattcggttgattataatcagaaaattgaacatattctaagttgataccttcatctttcaaacgatctttgacatcatcccaaacatccgtgtcggcaccgatcactccaagtttgacggttacttctttctcttttgttccagcattgctattgctgcacccagtaataaataataatgccgcacctaccacgattgctttaagtaattttttcattttcttcctccaatagtttctacttaattttatttgttttttttgtcctttttagtggctgacttttttaaccaacagattgctgacaaattgactaaaaaagaccaaaattaaaatgatcagtgtcgccatgatggtgacgtcgttttggaaacgattatagccgcgggtgatcgccaagtttcctaaaccgccagcaccaactgcaccagccattgcggtcagtccaatcacattgatgatcgttaaagcagagacgcgaatgatcccagccaacccttcgggtaaatagacccgcacaataattcccaatggactggttcccattgcttctgccgcttcaataaccccaggatcaacttctaatagggcaatttcgatttgacgagcaaagaaaggaatgatccctgcaatcaatggaaccaaagcagctgtttccccaatcgttgttcctacgatcaaacgagtcgtcgttcctaacaaagccaataggataataaaaggaatggaacgtacgatgttgatgattttatccaaaagttcaaataatccgcggctttccaaaatacctcctggtcgggtcacgacaagaacaatgcccaaaatgattcctaaaatccctgcaatcagtgctgtccaaaaggtcatgtataatgtttggatcgttgcttctacaaattcatcagagatagcaacgacattgggaaaataccgttcaaaaaaagtgctcatctaaaatcctccttcaatcacgttattcaatggttccgcgtgattttgcttaatgatattcgtgtaaacaccttgatccgcgagaaaatctaatgctcgtttacgctgcccatattcccctgataaactaacgatcaaactaccgatgggaacatcttgcagaatctctacgtttccgtagaggatattcgtcgtaacttgataacgactaaacaattgtgcgatcaatggttcattggtctgatccccaacataagacagttccaccagccattcgttggcagccaatgaggagaatttcgcactgccgagaatcgtttccagcgcttgatcaatatgagtagcagtccgaataaagtcttttgtcagcggttttgccggctggctaaaaatttgaacactctttccttgttcaatgatctcgccattttccattacagcgactttattacagatttctttcaccacttgcatctcatgagtgataatgacgatcgtcaaccctaatttacgattgagttttttcaataatgcaagtatctgtaatgttgtcttaggatcaagtgcgctagtcgcctcatcgcagagcaagatctctgggtcgttggctaatgctcgtgcgatggcgactcgctgcttttgtccccctgaaagttgactaggaaacgaccttgccttttcttccagtccaaccaaggacagcaattctgtcactttttgacgacgttcctgtttggagattcctgcatatttcaaggaaaaatccacgttgtcaaagacattccggctatccatcaaattgaaatgctgaaagatcattccgatcgttttccttttttctcttaatgctttagccggtaatgcggtcaattcagtctgattgactacgacactccctgacgttggccgctgcaataaattgattacgcgtaccagggtacttttacccgcgccggaatagccgacgatcccataaacatcgcctttatctacttctagtgacacatttttgaccgcttggatcgtctccttgtttggttgtgtaaatgtcaccgatacatcctttaatgaaatcatttttttcctccttattatcgccgattgattaactagttgatttttggggatgatcaactacgcttcctccggtcaactactactgctcatcatctgctcgtctactctatgcttcgcctacagttgcttctaagctgacgctaagaagaacttgcatggtctttgaccaatcgcagtgattcggggtgaggttactacgctccctccggtcgcctagtactgttcatcatctgctcgggtctttgaccaatcgcagtgattcacagcaaaaaggcgtcctcaagcaagccagttatggcttgcttgaggacgcctttttgcgtgttaccacctcagtttaagctatattcacatatagctcctcttcgagtacgatcatactctagcaagataacggatgctgccgtcgccgccttgcatcattgctcgggacgaatcactccttggccattttccaaaattcgtttcctgcttcttttcagctaccgaagctctctgtttaggaacattccttttgtacttaccaattcatcgtgttgactctatttttttatgccgctttttattttcaaagatcgatgaaaacaaaaaaagtccttttaccagcatctgctgataaaaggacgatcactcgtgttaccaccttttgttcagaaggtttcccttccctcaacccaacgtctatcaagaaaattccatcaagagattggtgctccttttaacggtagagcagattccgtgattgcctacttatcgacaatcaatcctccaaggccatttttcaacgtttcagacttaactctttccaccaaccagagtctctctttaaagtatctacgattactttccttatcaacggatagttattcttgttgaaatgtactttaccggaaaaaggataccttgtcaatcagaaaactattttttttcagaattttttggcaatgctagaatctgggcatagcgatcttgccagatccgctcataccaatgaatgatttcagcagctgaccagccttcgaatgcataagtagtcgttgcttgctgatacaacacattctgataccctaatccatgggcaaatttgatcgtgccatccatacaaaattcagtttgcgcaccgatccattcgatgctgcgaacatggtgctttgtcaacaaggactgtaaggaggtattgaaaaagctattcgcatgagtcttgcgcaaaaacaagtcggttgcttgcacagccaaatctggatgtaagagccattcatctgtttggtagccgagttcttcttcctcatgctgcacaaataaaacggggcgttgtgcatgacggtaagtttggatccgctggttggcaaacaacagcagcgaatcgagatgatccagtttggtgccattgtttgaacacacgcctttttgtaaatcaacgatgatcagaatatcttgcatccacttctcctttagttttggtataagattcctttatcagccaacaattgctttgcttgctctaactctgctgcttcttggtagcgtaacgtatggagatggatcccattggtcaaatcagaaagcaggcgggcttgtgaatgctggtatttccgcataaagtctgcgacatcttgttccgttttgatccgcagattccctgttaattccccataaatctcatgctcaacgatcacatcaatcacttcgattccgcaagagacaaatgtcaacaattcttcttctgtttgttccggacggtgttgcacagcaagtttgctgacatgacctgtctcacttgcagcttctaagcggtaaccgcgagcggtagccacgatagcctctcctgctgctcgcaacaaggcaatgtcaccaacgatgatttggcggctgacacctaacttacccgctaatttactagcactgatcggtttctcggcggtctgcaactgcttgatgattgcttcccgtcgtgttgctccatccatcattatccctccaattgattcttttgataagtgcgagaatgttccatgatcgactcaaaggttacgacaatcgtttcttcgaaggctttattggaaacggactggcgaacattgttcaaaacagcttcttcccgagattcatccagaactgctgtctgttcctgttttttccattggacgatttcactgactgctgtcatgcgtttttctaataattctgtcagttctcgatcaatcgcatcgatcgtctcccgttgatgatcgatagcagcaacgacttctgtcgtgcttttagttgcgggagcgacatcttttgcgatctcttcgatggtttcaccagattcaatggttttgatgatccgagctggatttccagcgatcaccacgttatcagggaacgatttagtcacgacacttcccgcaccaacgaccacgttatcgcctaagcgaacacctggaaggataactgcaccgccaccgatccaagcattgtcgccaactgtaattggtgcgccatactcaaggccactattacgcttgactggatgcaatggatgagaagctgtaaagagacgaacatttggtgctagcatacagttatcaccaaaggtaatgggacaaacatctaaaaagatacaatcataattggcatagaaattttttccaactgaaatattatagccgtaatcaaagcggacattcggttcgatatagatacggccagccacttgaccaaatgtctcttttagcagttgttctttgatcatcggttcggattcccgattgatcaagtgcatttgttctctggcaaatttgcgatcggcaactaattctggatctggtgaaaaatacaattcaccagcaatcattttttctttttctgtacgttctgtcataatgtgcctccatactccttttcaattttagtgtgagagttttgcaaaaactgtttccccacttgctaaaacttgaggagtcgtattttgttcaagcattgtttggttgatgatcaagcaattctggctattttgatactgcaacaaaccagcaaaaggatagacttgtaatgaggtgcctaccacgaccactagctgtgcattggccacagcgttgatagctgcagtaattgtttcttcgctgaaaccttcttcatacaagacgatcgctggacgaatctgtccaccgcaatcggcatgatgccagtctgtcaaataggtttgccaaggaacttctgcaccgcattgacggcagtaacagcggtaaagggttccgtggaaatcaatacgctgctgactccccgcctgttgatggaggccatcaatgttttgcgagactacccaaacgttccgttcttgagcgaactctgccatcgtctgatggatcacattgggctttgcttcaggatggtagagatgtttgacaaattgataaaatttatccggctctctgaccatacaagtatgactcaacagatattctggcgcttcaatgccatgataaatccctttcaaagagcggtaatccggaataccggaaggggttgaaacgcccgctcctgtcaaaaaagtgatagactcggcagcttgaatcttttcgacagctgtttcaatcgatactaacattttgctgaactccttccgtgattgttctactttttaatagtatacctaatttccccattttttataaccatcatccgcgatttttcacaaaccttcccttgaaaaagcctcaacaggaaggaaatcttcacttggaattttcagctcatttcattgattctttcatgacattctacaaaaaacgtggtaaactattcacgaatcaaagtgaggtgaaatacattggtagcatctattatttattgggcaatgatcatcatcagtttcggctggttggcagttagcttatacttctctattttctatttatctcgtaaagaaaatggaaatctatgggcgtttgctttcttaaatgtcatcacagcaatcattcaagcactcgttctattggtttatcgtacattaggtcaagactggggcgttacacaatactcaagtctcatttatttagctctaggcttattactaggtctgacagttattcaagctgtcttaggccgcgaaccaaaagccaaagttgcttaaagtagccgaaagtaaagaaaagcagttcccttttccaaagaaaagagactgctttttttgttgaaaagaattgacaaatccacctttttcttctacactcgattaagtatcataatcaaatacgagtatcctttaacatttaggtagaggtcgcgaggttcattaatcctgctgagtgaagcaacacgtcaaaagcagagctagggaacatcgccgaaacaaactgattcttgcttgaattattttgttgggacgcaagtgaacaacttgcgtactgtcttagcttggctaagttgcgctatgttttgtgaaaggtttgtcgacgaaattgtcaacagccgttttccaatcatggagtacggctgtttttttgttacctttgcctgtctgtagtgccactcgtgaaaggaaagagaaaatgaagaaaatgaattggttttgggcatttttcgccctctgtttcacacttgtcaatgtatcgatgactgctcatgcagatgatcaaactccagctgatcagtttcgagtggggatggaagcgggttatgcccctttcaactggacccaaaccaccgatgcccatggagcggtacctatttctggcgagaaagggtctgcctatgctggcggttatgacgttcaaatcgcgaagaaaatcgctgatggtcttggcaaagaattagtgatcgtcaaaacacaatgggatggcctggcacctgcattacaatcagggaccattgatgcggtaatcgctgggatgtcccctacagccgaacgacgggaacaaatcgattttaccgatccttactacgaatcgaacttagtcgttgtcgttcaaaaagatggtaaattcgcaaatgcgaaaagtttagctgatttgacaggtgcaaaaatcaccgcccaattaaatacattccattacacagtgatcgatcaaattccagaagtacaaaaagaacaagccatgaaagatttttcttccatgcgcgtcgcgttggcttcaggcatcattgacgggtacgtcagcgaacgtcctgaaggcgtcactgctacaggggcaaatcctgatctgaagatgatcgaatttgccgaaggtcaaggttttgaaaccaacccagaggatgtccaagttgccgttggtatgcgcaaaggtgaccccgatgtccaaaaggtcaacgagattctagcgacgatccctcaaagtgaacgcacgaaactcatggatgcggctatcgaagagcagcctgcggacaccagcggagattcagcgaatcaaggtctgctggccgatttcaaaaaaatcatcgatgactatggttctctatttttacgaggggcaggattgacgcttttcattgcgatcgtttctactgtcgtcggattattgattggtctattagtcggtgtctttcggacgctgccagctgctgaaaatcctgtaagtcgctttttccaaaaattgatcaatgcattattgacgatctatattgaagttttccgtggcacaccaatgatggtacaagctatggtcattttttatgggactgctctagcatttggtgtttccatgaatcgtacgattgcggcattattgatcgtttctatcaatacaggagcctatatgtctgaaatcgtccgtggcgggatctttgcagtggatgatggtcaatttgaagcagcacaagcaattggaatgactcactggcaaacgatgttcaaagttgtcttgccacaagttatgcgaaatatcttaccagcaacaggtaacgaaatcatcatcaatatcaaagatactgccgtgttgagcgtaatcagtgtcgccgatcttttcttccaaggaacatcggctgccggaacaaattatcaatacttccaaacatttgcgatcatcggtgcaatctatctcgttttgacaatctctgcgactcaaattttacgttttgttgaacgcaaaatggatggtcctagttcttatgtcaaactagaagatatcaacccagaataaggaggaagacagatgtcagcaattatcgaaatcgatcatttaaagaaaagttttggcgacaatgtcgttttgaaagacattagtctttcggtcaataaaggtgaagtcgtaacgattatcggctcctccggttcagggaaatccacactgcttcggtgtatcaatcttttagaaaagccaaccagtggaaaaatcatttatatgggcgaaaatgtcctagaaaaaggatacagcttaccaaactatcggactcatttagggatggtgttccagtccttcaacctttttaataacatggatgttctggaaaattgtgtcacgggccaagtcactgttctaaaaagaaatcgcgccgaagcagaaaaaattgctcgggagaatttggaaaaagtcggcatgagccgctacgtcaaagcaaaaccggctcaattatctggtggacaaaagcaacgggtagccattgcccgggcattgtcaatggatcctgatgtgatgttattcgatgaaccaacttcagctcttgatccagagatggtcggagaagttttgaaaacgatgaatgcgttagctcatactgggctgactatggtcatcgtgacccatgagatgggctttgctaaagaagtctctgaccgagtgatcttcatggacaaaggtgtgatcgctgaagaaggcacaccagaagaaatctttatccatccaaaagaacagcggacgaaagaatttctatcgcgggtacttaattgatcctgtgctgaactagggtacaagttgcagacaaaatgatttagacgaacagtcagtgccttcctgtcttacaagagggcattgcttgtccttaccgaatcatcttcttgtcgcttgttccctggtttctttttttggccttggtcaactaagagttgctatttgatcatttttttgttattttttttaaaactagagaactataggagtaagttgatatgaagaaaaagttacgtattcaagactatttgtatgttggttctatgttgtttggtctattttttggtgcgggaaatttgattttcccagtgcatatgggacaagaagctggtagtaatgtagcccttgccaatttaggtttcttagtgaccggaattgggttaccattcttaggcgttatcgcatttggtctttcccaaagtacgggtgtcttcgaattagcttcacggatcaaccgccgttatgccattattttcactgtgttgctttatttagtgattggtcctttttttgcactccctcggttagccacaacttcctttgagatcggacttgtaccctttgtttcccaagatctccaagcacccttgttggccgtattttcactattattctttggggctgcgtggtggttctcacgcaagcctagtaagatattggattacgtaggaaaattcttgaatcccctctttttggtattgcttggcttacttttagtctttgcttttacgcagccaatgggtacaatccaagaggcgcctgtttctccgctttaccaagaacacgccttcttcaccggcttcacaaatgggtacaatacgttggatgcactagcctcattagcctttggcatcattattgtgactgcgatccgtaacatgggtatcacgaaaccttccgaaatcgcgaaagatacgattctttctggctctatcagtatctttctgatggggatcatctacacattgctttcctacatgggagcgatgagcctaggaaaatttgcgatcagtgccaatggtgggatcgctttagcacaagtagccaaccattacttaggccgctctggaagtctgctcttagcattgatcgtcattttagcttgtttgaaaactgcgatcggattgatcaccgcatttgccgaaacctttgcagaattgtttcctgcaagaagctacttgtttttcagtgctgttgccagcattctaccggcgatctttgcaaatatcggtctgacgaaaatcattgagttttcaactcctgttctgatgtttgtctatccgctggccattacattgattttgttggcgattattagtccattgttccagcatcgtgccagtgtgtaccgtatgaccacttatttcaccctggtggcagccgttattgacggattaaatgcttgcccggcattgattagagacactgctgtcgttcagcagttattgaaatttgcagagcaatacttgccgttcttcaaaatcggcatgggttggctggcacctgcaatcatcggtttcatcataggtctcgtttgggcttggtgcaaaaaagaaccgaaatccgtcaaaaatcattaattcaaaaaaaatgacctaccatttttgaaaggtaggccattttttttgataaaagactgacagttgaaacaaaaacaggtacaatagacccattaaaggaggatatttatgttttacgaagaacttatgatggatccgcaaacgttgatcaaatttaaattattccggcgcatgcttactttacaaaatccaaatcatccaatcgcgcaattagccaaagaaatggacttgagctatcagcaaacattcattgagttgactgagatcgatcaagatttacacgagttgaccccggatcacttgtcaatacttggacgtggtggcaagctgcagccccaaaatattgcggcaacgattgatgagtaccggttttatcttttgaacaagagcgtaccattcttatatgttctttatatgctgaatgaagaaaatcctaccattacggatttttgcaagaaatatgatgtcagccgttcaacagtatcccgaaaattcgaacatctaaaaaaccatttgaagcagtttcaattgcgttttacttatacagaatcgaatctcgttggcgacgagcgcttagtgcgtctttccttattcaatatcatttggttaggcgtccgggggatcaaatggccttttgccgtttctgagtctgatgcagaagctttcgtcgatgagtttgctagctattttcctatctctcgttcttatctagggaagctagagttaaaatattttgctgcgttggtccttttacgcattagaaaagcgaattttgcaaaatacgaccgccgttataattttttgatgaaaaacaatcgctattatgatttcaatcgcttgcgtaccacgttgactgccgatactgaattaacagaaaaacagcttaaaggagaatcaagttttatctatttgctctcccaaatgctacccttctacttgtctgaggaagatccttccttgcaacaaacattgacattctatacgactaaacagaatccgatctatccgttagtttttgatttccttgcccaaatgaaacagacctattttgctggacagcaggaacttttagatgatcctatcttgattggtaatctaatcaatgcgacctttggcaactacgtctttcgacaaccgtttcctaatatttaccggctgctcaccctttccatgggacatggtctgccacaggaacaattgcatcagcatatcgatcaattctttaccgactatcgctcttccaataatgtagactatatcaatgacaccaatcaagaacagttagcagcgatgtttactcacgtcttgttaccattctatgataagatccgctacgccaatcggctgcatgtcggtgtcgttttggaagacaactttttacttgtccaatccttgaatcaatttctgcaagatctgacctttgtgcaagcggatccttatgatccgcaattgaaggaaccctatgatttagtgattagttccaatcaattgatgaaaaaaatgaacccaacgatggcaacttatctatgggattatgcagctgctgatgctcaatacatcgatctttatcgtacgttgaaaaaatacttcaatgaaaaaaatcagcacgtgtaaccgaatcgttatcttttcttaagaacttccgaaaacttttgtcacagaatattcatatttagttagtatagtataagcataccaacaaacaaccctaacactttttcatttttaactccttcccgccggccacccaccggcgggtaattttttgtctctttttctctagaaagcaatctttaaaactttccaagcttttctccacaaaaaattcacatttgccgactatagtataagcataccaacaaacaaccctaactaacacttttcatttttaactcctagcctgtcagccacccactgacaggctcctttttttgtaaaattcctttctgtagtacaatcaatacaaaaaggggagctttatgacaaacaccattgaaacggttgatcagtatattgctggctttccggatcattccactgtattgcaggaggtccgaaatttgatcaaaacagtcctgccggatgccgaagagcggattcgttatcagatgccaacctatttccaaacagagaatatcgtccactttgcctgtgcaaaagagcacataggattttatccaacaccctctgccattcttgcttttgaaaaagaatggcagtcttataagaccagtaaaggaacaatccgtttttcgtttacagaacctattccttatgatttgattgctcgaataaccgcttggcgtttgcaagaagttttagcgaaaacaactaccgattaactaaaaaagtgtaacaaaaaagtctgtgagtgtaataaaacaacgtcctaagatcagcttgattgcttcttccgcctacatggctgctatctgctgttttggtctcttgttttacttacgtcacagactttttttacttttcgggccgcgttgctttgacctttaatgtgctgacctttaaaacgctggctaaagggatcatacgaatttgttgccgatcactttgcagtttcaaaacgacttgttctttcgcaaccgtttttccaacgatccaaccggtaacggtttcaaaactgccaaccttctcggttttcacttgtaagacgaccagatgtttgtcactggccgctttttgcaaaatttgccgaatctcattgatcttttcagtttgattttttttatcggcattgtcactgaagaaagtatccaacaaggttgtcgaagtcatgacaatcaacttgcccagctgtctgatgggagatgatttcttttccattggtctttcctttctgctaacagcagcgggtttctctaaaaccgcacatacgttctcgtttattgcttttattttaacaaattttgaggaaaaaacaagcgaacattccctttattgggcagcattttttattttttctatccaaaggggcagtcctgcttgaatcaagcggtatgtttggttgaaatctcctgtgtaataaggatctggaatatcttctccctctccaggaacgacacttaagtacgtgtaaagcttatgctgcatacctgctggagccattgctgaaaggtcctcataattgttacgatccatgccaatgatccagtcataggtttcaaaatcctcagaagtgatcttgcgggaaaccatgttctgccaagaaatccccgcatctgctaatagttgacgagttccttgatgaggcggattacccgcttcccatgaactagtggctgctgaatcgatctgccaaggcaattgacgttctgctattgcttgcttgaaaagcccttctgccatcggtgaacgacaaatatttcctaaacagacaaataaaactttcgtcatgattattgctcctctttttgataaatttgataagaaaaaaattccacatcttttgccaagcgaaagagttgggtcgcgatttctaatggcatttccggaaaatcatcacgaatccaagtttctaagattccactacagccataagaaaagaaacggctgtaaaaagcaatgtcttgttgcgacaattgttgctcttcatcgacttcatcaaacaagcgctgaaataaaggctccgtaatttgataaaactcactcatcagaatatcccggtcataagtaacagatttccgatagaaggttccgttttgccgcatcgccttcaacattttcaaagctgcttcttcccaattgtctagcgaaatgttttcagatgttagataaatcagcgcatctgttttgtagatccaacgaatcaatgcttttttatcggggaaatgataataaaaggtttgtcgattgatctgcgccttctcagccagctcttgaatgctgattttgtttaattcttttgtctcacaaagttcaacgaatgtttgaccaatgactgctttggtttgattcccttctgccatggtacacctctttttcaaattctctccttatcataccaaatttccaactaaaaaagtattcttgcagaaaaaatcccagctatttcactagctgggatcaaaaaaagagctgaaaacaatttcagctctttttttaataatgcaatccttcacgtcccaatcggttgggtgaacttatttctcaaatttttttttcaaaaattctctgcggatgcccacgactttctcggtaaagttgacccaatccactggacgcggcggcgccagccacaaaatatgattgatccccattgccccataaaaaggcatgtttgaaagagtcagatgagtcttttcatcaggaaaactttgaaactgaatattcaaatcgagaatcttttcaatattgttgcgaatcatttgattatacgaacgaccataagaaaaatcgacacatacatagagaggaacagatatttcttttaatgggatcgttgagatcaataaaatcagatagcgaaagaatagaaattccttgttgttccacaaaatgggtcggttccggttagcttcaaggtaattccgacaaaaagccacatattcagggtatgtttgcaggaaataagtgacgtccaaatgttgatactcgcatcgcgaactgaaagaaaatgaaagcagttggtaatgaatgttcgtcaattcagttgtaagcagtgctagaagctcttgggaaagagcaaaacgaccactaagttctgtatagaaatgttcatttaattgggtgatataatgattttgatcaatgtagcggtcattttctactaaccagccttctacgatcagaaaccgcaatatctcctttgcttcccgctctaaggtagtcaggctcaccgtaggcaagatcttcgccagccagtctttcagctcttcaatgattcgtaagtgttcagcattgatcaaaccatcctcaactgtattttgcagaaaatgaccattgcacattcgggtaataatgattcctaagtattgttctttgcggatctgcattcgggcagatttctgagggttcaaccagccttgactattaagcgcatcgaaagtctttctttttgtttcgatttctttcggaaaaaccgactgattcaaatagtattctttcataaaaaacaataatatgaattcccttatttcattttcttcaccgatcaatcgaaattccttcgtcacctcaatgtcataatcattaaggatctgcttgaattgtttaaattctttatacacaggcgtatggcttaaaaaatggttcgtagcgaattcataaagtgaagacagttgttcaaaaaaacattctttcagcatggaaaatttcagtgactggtccaaataataggtcaagacgttatcagaggttgccaaaccagaagcatttaatttgatcacggtcccatcagtcacaataccaaactcttcatccaatccaaattcataaaagtccgtgtttaattcttgaacggtcttgttgatcaaaaattcggacattgtcagattatccatcaatgcctcttttgtctcggataaagaaaccgcattttccaagtattgaagcagcaccaattttcgcttatccgctttattcaaaaatgtcaaaaacatgcgttttcaggcctccatcattcttttgcccataaaggacacttccggtaaataaatagcacaagcttgtaagataagacggctgatcattgccatcaccacctgaatcatcgtctggcattgctaagtcgaccgacagactatttgcaaggaagatatcttccaccgtcacgcgttttgccagctgcttgccatcagccaaaaacggttttgttagattcagtaacggctgttccttttgactgttttcttttgatttgggttcttccttaggcgatgctggttctgctgcttttggtgtcttctcatcaacaggcgcctcgttgatttctggagggtctttcggaacgatttcttctgaaggattcagcggattatagatggtagcgaatacgacctgttcggtaacaaggtcgatcattccgataataatacaggctcctaaaacaaagccaaatttgcgtttcattgattatttcaccgccttaacatagttctatctggcatctcacttgggcctctcctcacgtaccatcaataatcgatgaatctatcaaagacagccccacaccattaggtgtagctgaaaaagccagctgttcttacttgctgctaacttgttgtcctaactggagatctttctccataagacttactttgagaaacaggaaagaaaatgattccgcaatgaatcggctatcgctcatcacttttcaaaactagttactctccttcattctttttctgacgatgccaaacaatcagaaatgcaatgatcaccaagaggagtccaatcaataaatattgccacgtatgatcttcttcgatagtgacatctttccgattgaggtctcgcgcaacatcgccagccactgtaaactcttttttaaattcccatctgtataaatatctttcttcctcatcaccattcttgactttatactgtccttcatcgctttttccgctgtaggcaacagatttcagcaggtaagtacctgcttcaagcttttgtccttctaatgagatgggataagaaaaatgggaatttggtgccatctgcataccagaagtatcagaagaatagcggctgtcgttttgcccttttttagtgacatcgttgatcaaacaaaatgaattcaaataggcagcggtcggattttgaaaagtcacattgattacattgcgggcattcacttgatcaggttcgacggctaacaacttcaaatctggaacgatttcatccgttgtttgtctcaacaaaattgcgacgacataggcatattcatttttgatcgctaatccttgatcctcggactgatcagaggcttcttcctgcttttcttttaatgtcagtccaccggaaatcacgcctttaaatgattctgaaggcatgcttacttttaaaggcaaagtcacttgagactgtttgggaatcgtgatggtctctgcgatgtctaccaaatccttcaaattgtgcgttaaggtttcatcaggttcgatatcattttgaccatactcaacaacgccgtttagattggtggttgccgaagcgatcttcggctcaatcactacgtccttatccgtatcatttcttaatagaacctccaccgtttgaacagcacctggtgacatcttcaaatcaaaataagtcttagatttgtctatttggttctctggtatgactggatttactgcaaaattgaattcagaggccatgcctcttaccgaaataaaaaagaaaagacttgccaaaaccagtataatgagctgtttactttttttcatgatggattttccctctctatctatgtaccacccttacgtatcaaaaccttacacttaaagggactggttgctatggatttgtcggggtatcagttagcagccaggtaaatgtggtactgtacttcacggcatatttcgttgttgaaccaggcacttctaattcaatactatctactgctgcgaataaactgtcaccccagctcataagataagtaccggctccttcccctttttgggcactcatgactaatgattcagccccattgggatccagggtaatcgtgcttttaaaattagaaggttttggggattcggatggtgtaacgatcgtcccgttagtcaagcgaatttgagctgcttttaattcttggtctttccctgttttaaattggccattttgtttgacatgcaacgtccagccgctttccgttcctcggttatctgtgacttgtacaaaatttggtccttcttgttctgcacctgctgcatcctcatatttttgcaatgaggcatggtagacttccgtttttgaagtgattttttgcatgccaaaatacaaactggaggcaaagtcgatcgataacggtccgttggttcctggttcaggtttgccatctggcgtggtgggatcgactggtttgattggattgtctggatctgggtctattggactgattggatccgttggctccgtgtttggttcaaagacaatttgaccatttgaatgataagctgccacttctgctgcttgagcagtgatcgtgctcgtcattcccaatcctacgaatactgctgcggttactatttttttcacttttctgccccttcttattcagtctctggtacatttttgaggtaccaaatcaaggttgttcgatattctttggctaatttaaccgaacgaccaggaatgtttaattttacagctgccgctccttctgatgcatcagcaccaaagcgatagatccaagtccccatccctttgcctgccgggacattcaccaagttcatttcactattgggaacaaatgtgtgattctctactactgttggtgcatactgcttatctgtcacagaaattgctgttccggaagaaattgataatgaagcccctgctagcacttcactctgtgctgtcttaaattgaccgttctgtatgacgctaagagaccagccttcttgagtcccccgtttatctgtgacttgcacataattcggacctgctaaacttgaagtgaactcttgcagttttgcatagtaatccattgtttctgatgtgatcttttgattgccaaattggaaactggaggcaaaatcaattgacaacggcccagccgttcctggatttggtcccattggatccgtgggatcgaccgggtcgactggtttttccggatcggtagggtcgactggtttagtgagatcattatccgtttcaaaaataattgccccatttgatgtatactctgctgcaactgcggtgatcggcaagattattgaactaaggatgacgatacccatcgttattaaactctttttcatttcatttgctcctttttgataaaatacctagtgctgccaacaagcaacccccatcgcgagttaactggaagagtcagaacccgttgtgggtaagattttatgtccttgttggtcgaatggctgatttctcagtactttcgcctatggtcttggattttttgctggatattcctaaacgccataaaatgacgttccgccattgctgtcatccgcgcctatttcagcagctaaggtagttgccaaaaacaagaataatcagccgagcaaacttgcattaatgactatttttatctttactcttctgccttttatggattgcctggagcagatactagttgccaggataacgttccgctatattcgcctattttttgcttttctaccggaacaactaatttaagacctttattcgctgtttctccccattcttgattcacatgatagtcgccgttttcggtcaattccgtctcttcaacgataatttccccatttgttagtaattgctcttccccattttttacaaagaacaacgtattttctaaatgatctgtcccattactcaagctctgctgttctttcacagtgagccgccaaggacttcgttcagatcctcgtgtatctttgacaatcaaatctccttgaatgtcaggccaatacgtttgagtggtggtagtgattttttgtgccccaaaatcgatagttgtcggtacactgctcaaggtcaactcaccagcgatcgccacattcactgttttttcagcagtttgcccattttcggtgaaatgatacgtagttgtgacattttttagcagctcttcttcgcttgtttgctggatcgattcgagtgcttctggtgcaacttgcggcaactgctcgtctcgaccatcagcaaaaatcgttgcggcttccgtatatgctgctaaatcagcttgattcgtgatagccgttgcttcccctaaagtcaagcggctatctttggcaaagacagcgaattgccgattgcttgccaaggcactctcatttttcacgactaccagattgactgcttgttctacagatgattgatttgctgctcctgctttgaatgaaacaagatgcttgcgagaagttgctgaccccaatggtttttgaatctctgctattgcttcttccgtcagactatctgtaaagaatgggcgtccttgtgcctgcaaatagtccagtgcatcttctttagtgaggttctcagcttcttgttctgtaatgattgcgttctgagcacgaagttcagcttgattcgagtaagaaaccttcacttgatagctgtattcaccatcgggaatctgccaatcgactggatctgaagacgattgttctgggattgtttctgtcgcactagcaactttgcttgactggatctgtccagcataaaaccaagaacctttattctgggtttctggtgtaaaggtcagtatcggtaaatttgacccagtatacggaataagcagccgccctttttgaacctggatgccagcaatatctgttccccatgcttgaatcacaagtggcgcattattttctttaacgcctgtcacgtcatgagtgattgaaccttgcccatcagcgataccgggcatttcgacttcatagtcgatcactgaaccaggaatcgcaattccgtagccattgactcccgtcacatcattgtccccaatgaatgttttaccagtcgctttttcgatgccgctaaaagtgatcggcgtgatcggcgtcgcattgtttgcaactggattgatagtcaatacttggtagcttgtgacttctccaaaccaagtgccctgactttttgctcgtgctgcagcatcattctccgtatttttgatccaagtcaaatgatctttttttgaatctggcacttcaaaatcggaaaggttgatccgaccagtacccggaggagattcaatggttgcctcatcttcgatggttaacttactgcctgaaatcatgttgtttgctgaagaaattccaataccggcatttttcgacagctggatcgtcccaaactggtgataagtcgtactatggttggccgctgtagctgagcgcccattttttatatccccaccggtagccatcaatgtcaatccgttagtcacagttaattcggtaaaattcacgagacctaatcctgtcatagatatgggctcatcttggtaagcattggttccatctacattctcgccaaaattcattttgacttgattggtgctgttagcaacgattgcattggtgaaattgtccgttgcatttccgccagagatcccattgatacttttcgccccttgaatacgcatctctacatcgcgcaaaatctgattagaggaaatattcgagtaataggtggtatataaattaccaatactggaatcttccgcttgaatgttcatcatgatcttgccgcttctcgtattgctagcagttcggccgccatccccataaatcgtggcaccgttcaagacatccgatcctggttttgtatagatgttcagcgtaatcgtattggatgtatctgttccgacaatatttgtactgttgaatggatttccgccagaaatattggtcccgctaggcagcttaaactcaccgtcataatttcttaaatccaatgttaaacttgcatttcccaatagtctgccattattagtcacaccgccagaaaaaccattagagccagttcgtggggtaccggaaaagttcccgccgaaaatccgattattcgaatttccgttgatcgtatgagaactggaatctccgtatgaagcccctagagaggcattgatcaccccatcataaaccgttactgccacgttcccaccaatcaagagatcgttccagccgccgccagacaagaaccaatccacttgtccgttattgactgtcgtttcaccattaccatagactcttctaccggtatagccagtaccttcaagggtgtctacgatccctgagttcaatgtattcgatgcatttccttcaataactccagagaaagagccgccataggtccagcgagcaaccgtattatttagaattgttttagtattccctttgatgtagatattccaggtagttcccggatctcccccaccgccgacaatatcccagccagatagttcccctcgatttttggttgttgtggaataagcaaggttggtcggttttgatcctttataagcaataccgtctccacctggactgccatctgctgtaatcgaccccacttcaatcgtggtattcccatcaatataaccgccgcgacctgcagctgtagtatatgttgcaccatttgaaaaagaaccgctgaccagatgggaggtaatattgccgtatactttgaaacttgctcccgcttctgctaattgagcccgttgtgcgggagtataattgtcgtaagtcgttgtattcgaagctcccatcgaactttgtgagagcgtgctgacattgttcccgccgccgccattgaaatcaccgatcccaccgacactagcgctaggacccgctttgaccgtatttacgatgtttccattgattgtgccagagtatcgattaccaccttcaaaagttgcccggcctgtagaatagagactcgaatcaagattcgttacgatggcatctttagcaggttccgagccaatatttccataataggaaccgccgataaaacgattggctgtcccagtccagcctccactaccggaaacagtgctgttgattctaccgtcgatcgttccatactgaacccctccgacaaacgttcccaaccgaaaattggcatttttcgtagcaatcgtcgtttcaacattcccagtcacattggctgcatttgtagcacttgatccaacaccaccgccataatagtttgtcaatgtgccattcaattgcttgatcgctacttttgtattgccatcgatcgttccaacattggctccccctgcaatggtacttatcccagagacggtattgtttacgttgatcgttacattccccttcaacgttccgccgctttggttgcccccataaatattccaagtacctgaacccgtgttattcacatggatcgtcggattgccttccagatccccactgtttgtgccaccatatatcgtaaagccatttccaacggcacccccattgaggaaaagactgtgcccgttcatgtaaatcgtcgatcccctatagtcgatattgcgaaacacgatatccgagccaaaataattattcgttgagaaatcaacccgtcgactgcctgaagccaatgttgtcgcatctgtgatgggatcgttagcatgaccagttaatatcaagcgactaactttcccttgtaatgcataaaacgtgatattgctactgtctactgtgcttggtattgttttggctgtcagatcagccggtaaagtcaaggtaccccctgatccgacatacaaagcaaactcaccgccattgccattttgatacatatcaaacaaggcttgccgaaagccatcgacactatttgcatactcagcgtaagtttccccatcgcctgcaggacttggaacggcaacaagtcgtgaaggatctgcacttgcaataatatctttgatggacaggtctactaaggaaccgctagaccggacactcacgccctgtttaaaaactgctagcaggatctgatcatgatctaggtccacgttttgcaatgcttcattactataaatttttccttctagctgccagccttcaaaggatgccggatttttaaaggaaggaatgtccgttgctgtaagacgttccccttttttcttgctgatttgaaggcttgtttctcctgtttccaacaaacgcccttcagcacttttgaaggttatcgtcagttcttctgactcttgtgaagaactagtaacagattcttgggaatgagattcagatgctgaatgtgctggcgattcatccgattctgctgtttcagtcgcttcagatgtttcgtttgtttcgttatcctgacttgcggtaccttcactgctttcactgctactttctctgttactcgtgatactttccttattatctatatcgctaagcttttctaactcgtttaaagtatccgttgtttcacttttttgcgcgatactttctgcatgtgcaactacctctgtatatgaaaaacaaggagaagatactaatagaaaaacaagaaaattggttaaaaaacgattcactttatccctcctgactgagtgaaaatgagtaaaatattgcgcaatacacgcattatgctatccatagtctatatccaaataaaaaaaggattataatttttttttcatccattccaaaattatgattataaattgacatcctaaccgcttgtttcttctcatttttggccttgtcaggcagtttgtttgacatttacttgaaatgcttggaaaggataaatttagagttaatttcacctagcatactaaaaaaacgtaagagttcaagagatataattagaataagattataaaaatcacataataaagcaatctttaccactgaaaaattaatctattatccgaattatttgtacttgatgcccctatatagaaatcgctaacatcatttatatttcatagaattaataatgttataacgaataataattcactgtattttctaaaataaaataactcaaagtataataactgaaaaaaattttataattttttctaaacaacattagaaaaataatacaatcataaaaaataaaataactattaatctaatttaacagcatgtatttttatttccgtgcgcaaaaaaagcaccaaacagtcctctgtttggtgcttcattttcaattatttggaaaagaacgtccatcaataaatgttgtatagatatgctcgtcctctacttgctctccttgaatcgatttgacgattttctctgaagcaatcattccccaacgatgcttcgagtaagaaattgtcgacaaccgcggctgtataaacgcccctaattctgtattgtcaaaaccaatgatgcggatatcttctccgatttttaagtctgttttacgtacatacttataaaccccgatggccatttcatcgtttaaggcaaagatatcgattggtcttagcggattttttgctaaaatttcttctgctccccgataccctgagggttcagtaaaatcaccagctattacatcataggaaatgccaaatcgggtaagctctttgatactggcttctaaccgttcttgactatcataacttttttcaggaccagcaagtaaaaagacatgttggctgccacctgaaatcaatttatcaatagccagtgccgcaccacctttattatccaaaaggacttgatggatattttcatgatcgaggatccgatctagtacaacgatttgatgtccccgctgagcataccgctcaatttcctctgaaggaaaagtccaatctaaaacgatggctccatcgatcatacgctctggtataaacaaatgggattttttgccgctgcaaacaatcatttcgtaaccaaaagtctcgagactttttttaatcccgtctagcaactctccatagaaactccccgcgtagtctgcgaggtacacgccaatgatgttcgtttgtctgcgcttcagtgtacgagcagccatgttcggaacataattcaagtcacgagcaatcgcttggatacgggcgcgcgtctcctccgtcactttagggctgccgttcaaagcataggatacagtggaaatagacacaccggcttttttagcaatatctttgatccctaccatggctcctcctttctatcgataaatatcgatatgatttatttccttattgaacaacggcagcactgctgatttgtctaaacaaaaggccccttttcgatagctgttttctgctagtgtatagtctaccggttggccattgatcaatacctgttcttttgacgcttcgtgaaaatggatcttaaccggttgatcaaagacccggtaggtcatcgttaagtcagataactcagttggcaagacaggatcaaggaacaaatcatctgccatttcgcgaatgcccaagacattgctgatcaattgattcaaatagatacctggtccgctggagtacacgcgccaaccgccttttacaccgacgcttccatctctaagtttaccaaaattctcttgggcttcaagccttgttttgaaatcgccgtcagagctgctgaaatagacattggcttgtcgcagttctgcatttggcacgcgttcttgcaactgaataggattgatgacccctaaagcatgccaagtttcttctttttgtcccaatttggccattgcttcagtaaaacggatgtgggcatgaacatattgcaacccgatttcccgaccaaagttcgctgcttgctctgcacgtttgaaattcgtactgaccccaccatgataagccgctggacgattcatcaagcgaacgccatctggatgttgcaagtgttctttgatgatgcctaaatggtgctcggcttcgtccggagaaagtaattcaccgatcatgctttgctgcatcggcaacaatcggtactgaatccctgtctttttgtcttctggatggatcatcaattccacatgttcagggtcttccatataaacaaatcctgggatggttcctgaggacaaaatgtatttatcaaaatctgtacgaatgccgctgacgatggtttgtaaatgatcagcataatttggatcatagtctttcagctgttccgctagtttcttcatcacttcataagttaatgcaactgtccaactgctggccatctgctttttcaatttgctattgtttggctgcagggtatcatcccagtccccatccccataacatgaaagatacgtaccttccaagaaattcgcttcgatatatgcaatctctttctgtaaatgatcataaagagaagcagtttgacttgtctttaagaacgtttcgcgatctgtataaggtatttgcgtttctaaaatcgcgaagtccttcgttttttccaagtaatcgctgacgactttcattggccacacaatcacatctccatgactttcgtcggctttttgtttttcgtagcggtcaaacataaaccattgcggccaattgccatcgtcggcaaattgattggcaaagaggtgtttgatgatcgacgcaacgatctctggacgattgactgctaagaaaaattctgttggtccttgtgagacatctctggtcccccaagcagcaccgccatactgttccaaaccatgaggagacaaataatggaccagcatgttgtgcgtgtaccaccgagagagcaaattaagagtttggacttctgcttggtcatgggtcaattcaaattgattcagcagtgaatcaatgaacgtcacatattttgcttcttcttgctgcttagaagacgcttgttctcggtaaggatctccggtcaacgttccctgaatcttaagggtaacttctgactgatccgcaaatgtcagaacagttagtgcgccatcactgttttcttgtaagaacaaggaatcatctgtcacatcaaaaggctgatccgcctgcagataataagttaattctggatacgcttcttttactggtgacgtagtcccgcttgtgatcactacttgctgctcttttttcacaaccgctgtcggtgcttcttcatctggccccatcaaaaactggttgctgatggcccatgaataagcctttttgctatggatcatcgttcggatctcacggctgtcaagcagtgtatacgtcgtgaccgtgatcaaatcatctgctgttttgtaataccacgttgcagagttcagccccatctcgaacgcagatggcatcgtcaataagcgccacgtatcctgttctttcaagtagatccgctgtcctgatcgtttcatgacattcaacgcattacggctgttactcaataatttattcattgacgtattccctagaacgatctgcgaattgaaaataccatacatataaaccgtcgtactaagcaacggctgatctaccactagatcactgccactcagcaatatatgcccatgagcccgttccatggcactttctttttccttcaacacaacgtgacggtagttttcggtaaaaaatgaatacatttggccatcgattcgttccattgcttcctgttttggaaatagcgcggaaatatctgcttctgacaaggtatctccagtcaatgctgctccgagttgttttgccggaagtagctgtgtcgtcaatgactcaaaagtcaatttttgaaactgttccttcagagaagggcggtcgaattgcggaccggatactgcttgtggctgatctgccttgacagcactataaaaaatgacttctgttgtttcgtcagatagctgataagactcggactgcaaagcaatgtaggcaaattcatattgatacaattcattcgctaatgtttcgtgcgctaaggcttgcggcaaattagtcaccttgtatgttctgccaaaaaattgatacccatctgttgaataactccgcaagggttggaaacttccttgttcgactaatggaaatttgccggattgcggttgattttgacgagaagagacgacgatcgttccgttatcctgagtcacgtggtgatccagatattgagaaacatacgcttcattggactgaactgctccttttagtgcattgcctatatcttgaccataaatgatatctgcttttccagaacccgttaactggattcgccaaaaccagcaatcttctgccagttgcaagtccacttgataatgaacgtccaaaaactctcctgaccaagacaactgctgttgggaatacccaaacttactggctgaattagaaccgaccatcggtgtccaacgaatcccttctgatgtatagactcgcagatacaattgattcaaactgccgtctaacggattgccatttagttgattgatcatcatgccattgctatctatttcatacagatccccggttttcaaaaacctcaggcgtgtctgattcttttcaagagtaatatattgtgtcatataaaccttcctatccttatcttacgaatttgaatgtagccatctgcagatcgcgactgttgctgccgaccatggcttggaatgtgccagcatcactggatgtttcctgattgctgtggacgtaacgcaacatatcttccgtaattgaaaaagttacttctttggtttcccctggttctaaccatactttttggaatccttttaattctttgattggtcggacaacttcaccaacgaggtctcgcagatataactggacggtttcttcaccagcaaagtcgctattattcttgatctgaagggatactgtcagtgtctcttcagcagacagttgtgatttatctaaacttaactcactatactgagcctcgtgatagctcaaaccgaaaccaaaaggatattttgcatagttggagacatccaaatatttcgagacatatttttcatcaggtgcactttcataaggacgaccggtagtttcagtattgtaataaacaggtacttgaccgactgtttctgggaaagacatactcaaacggccgcttggattgtattgtccccataaaagatttgctaatgcgtgaccaccttctgttccagggaaccatgcttcaacgatggcttttgcttcatcaatgccttgaagatctaatggacgaccattatacaaggtcacaacgagttgctcattgactgcctgcaattgtttgaataatgctaactgcgcttcaggcaagcgaatatcgctgcggctcgctgcttctccgctcatccagtcttgttcacctagtgcgagaaccactttatctgcttgtttagctaatgtaacagcttcattgatcgctgcttctgttggcgcaaaataatcgaatggttcttttccataaagaatgttctctgaaactgctttgctcccttcgatcaatgaaacggcttcttcttgtttcccttgccatgaccatgcacctaaaatatctttagagtgagccgctggtccaatgatcgcgaccgtctccgttgatttaaatggtaagatgttctcattcttcaataaaaccattgatttttgagcgatttctctcgcggctgttcgatgttcttgcgaaagtacgaccctagcttcagcagcttcatctgccccacgatgaggattttcaaaaagaccaagatcatttttaagggtcaagatccgcaatactgcttcatccaataactcttccgcaacagcgccttcttcgatcaattctttcaaataatcgttgtagcaagtcgtcatcatttcaatatcgacgcctgctttgatcgctaattctgccgcctgtttctcatcctctgctgcgccatgggcaatgatttctttgaccgcaccccagtcagagatcactacgccatcaaaaccaaattcttttcgcaacacatcacggaacaaccagcgattcgctgtagccggaatcccatctaccgtattaaaggaagtcatcaccaattttgccccagctgctagtgcggcttggtagcctggtaagtaactttcccgcaattgacgctcagacatattgactgtgttgtaatcacgaccgccaattgctgcgccatacgccgcaaaatgcttcacacaagcggcgacccgttcaaaatcattggtcaagtcttctccttggtagcctttcacgaaagcctccgcaaggcgactgttcaagtagggatcttctccggtagattccatcactcgtccccaacgagggtctcggactaagtccaccattggcgagaacgtcacatggagcccagacacagcggcttctctagctgaaatttcggccatttgttccgcagcattcagatcccacgaactacctagagccaatggaatcgggaagattgttcgaaacccatggataatatctgccattagaatcgtcgggatctgcaggcgattgtttttgatgtattcttgttgtactcggatcgcttctttggcaccggaaacgcctagcgttgttccagcgttgttgatggtttcttgggtcagtcccagatcactcatcggtccggttttttcttccgctttgtctgaataaaacgcagcagccagttgcaataattgatcgattttttcatcgatagtcatttgttcaagtaagtgcgtcaattttgtcttttccatttttgttccacctttatcgttcatcgaatcggagatctgcttccaacgggaaatgatcggaaggaaaccgtccgtcacaagaatccgtcaaacacccggttttaatgattcgaaatcctttagtataaatataatcaatttcttctaactggttccatgggagttgatagtcaaaattttgataggaacctctgggaccgtaatgtcctttttcattttgttcttttgcgttaacaaaaatcgtttgcagggattcatggacgcgttcaactgcttctgcattgagatcccccattagtaaaacgggtaaagcggcgattttatccgctaaccgttccaagatgactttcatcccttcaaaacgggcgatttctgaaatattgtccagatgcgtgtcgatgactaaaaagtcatgtccttttctatctcttagtaccgtccacaaacacagacgcaagtattccgcttctggatgaatacttggcacatcaggtgtcagagataaccaaaatgagcctgaatctactttagaaaacatcgtcttcttgtaatagatcccgataccttctcctgttccatcgccgtctcgttcagcagttaccgactcgtaatcagtcaatcttgctaaatcagcgacttgcgtcggccggacttcttgtacgcacaaaatatcccaatcatgataatcgatcaatgccaatac

(The sequence listing continues in the following parts.)

What is claimed is:

1. A pharmaceutical composition that comprises:
a therapeutically effective amount of a bacteria strain of the species *Enterococcus gallinarum* deposited under accession number NCIMB 42488; and
a pharmaceutically acceptable excipient, diluent, or carrier;
wherein said therapeutically effective amount of said bacteria strain is an amount sufficient for treating cancer in a subject, and
wherein said bacteria strain is lyophilized.

2. The pharmaceutical composition of claim 1, wherein said pharmaceutically acceptable excipient, diluent, or carrier further comprises a lyoprotectant.

3. The pharmaceutical composition of claim 1, wherein said pharmaceutical composition further comprises at least one additional bacteria strain.

4. The pharmaceutical composition of claim 1, wherein at least 50% of said bacteria strain, as measured by an amount of colony forming units (CFU), remains viable after about 1 year of storage when said pharmaceutical composition is stored in a closed container at 25° C. at 95% relative humidity.

5. The pharmaceutical composition of claim 1, wherein said therapeutically effective amount of said bacteria strain comprises from about $1 \times 10^6$ to about $1 \times 10^{11}$ CFU/g of said bacteria strain with respect to a total weight of said pharmaceutical composition.

6. The pharmaceutical composition of claim 1, wherein said pharmaceutical composition further comprises a lipopolysaccharide.

7. The pharmaceutical composition of claim 1, wherein said therapeutically effective amount is an amount effective to increase production of at least one cytokine selected from the group consisting of IL-6, TNF-α, and IL-1β.

8. The pharmaceutical composition of claim 1, wherein said pharmaceutical composition is formulated for oral delivery.

9. The pharmaceutical composition of claim 1, wherein said pharmaceutical composition further comprises a prebiotic compound selected from the group consisting of: a fructo-oligosaccharide, a short-chain fructo-oligosaccharide, inulin, an isomalt-oligosaccharide, a transgalacto-oligosaccharide, a pectin, a xylo-oligosaccharide, a chitosan-oligosaccharide, a beta-glucan, an arable gum modified starch, a polydextrose, a D-tagatose, an acacia fiber, carob, an oat, and a citrus fiber.

10. The pharmaceutical composition of claim 1, wherein said pharmaceutical composition further comprises an adjuvant.

* * * * *